(12) United States Patent
Brandt et al.

(10) Patent No.: US 8,088,903 B2
(45) Date of Patent: Jan. 3, 2012

(54) FLEA HEAD, NERVE CORD, HINDGUT AND MALPIGHIAN TUBULE NUCLEIC ACID MOLECULES, PROTEINS AND USES THEREOF

(75) Inventors: Kevin S. Brandt, Fort Collins, CO (US); Patrick J. Gaines, Fort Collins, CO (US); Dan T. Stinchcomb, Fort Collins, CO (US); Nancy Wisnewski, Fort Collins, CO (US)

(73) Assignee: Heska Corporation, Loveland, CO (US)

( * ) Notice: Subject to any disclaimer, the term of this patent is extended or adjusted under 35 U.S.C. 154(b) by 698 days.

(21) Appl. No.: 11/565,729

(22) Filed: Dec. 1, 2006

(65) Prior Publication Data

US 2007/0270576 A1  Nov. 22, 2007

Related U.S. Application Data

(63) Continuation of application No. 10/621,901, filed on Jul. 16, 2003, now abandoned.

(60) Provisional application No. 60/319,414, filed on Jul. 22, 2002.

(51) Int. Cl.
    *C07H 21/02* (2006.01)
    *C07H 21/04* (2006.01)
(52) U.S. Cl. ............... 536/23.1; 536/23.5; 536/24.31
(58) Field of Classification Search ................. None
    See application file for complete search history.

(56) References Cited

FOREIGN PATENT DOCUMENTS
WO    WO 00/61621    10/2000

OTHER PUBLICATIONS

Metzler et all Solution structure of human CTLA-4 and delineation of a CD80/CD86 binding site conserved in CD28.° Nature Structural Biol. 4:527-531, 1997.*
Smith et al. The challenges of genome sequence annotation or "the devil is in the details". Nat. Biotech.15:1222-1223, 1997.*
Brenner S. 'Errors in genome annotation.' Trends in Genetics 15:132-133, 1999.*
Bowie et al. Decipering the Message in Protein Sequences: Tolerance to Amino Acid Substitutions. Science 247:1306-1310, 1990.*
Lerner et al. 'Tapping the immunological repertoire to produce antibodies of predetermined specificity.' Nature. 299:593-596, 1982.*

\* cited by examiner

*Primary Examiner* — Nora Rooney
(74) *Attorney, Agent, or Firm* — Sheridan Ross P.C.

(57) ABSTRACT

The present invention relates to flea head, nerve cord, hindgut and Malpighian tubule proteins; to flea head, nerve cord, hindgut and Malpighian tubule nucleic acid molecules, including those that encode such flea head, nerve cord, hindgut and Malpighian tubule proteins; to antibodies raised against such flea head, nerve cord, hindgut and Malpighian tubule proteins; and to compounds that inhibit flea head, nerve cord, hindgut and Malpighian tubule protein activity. The present invention also includes methods to obtain such proteins, nucleic acid molecules, antibodies, and inhibitory compounds. Also included in the present invention are therapeutic compositions comprising proteins, nucleic acid molecules, antibodies, or protective compounds derived from proteins of the present invention as well as the use of such therapeutic compositions to protect animals from flea infestation. Also included in the present invention is the use of flea head, nerve cord, hindgut and Malpighian tubule proteins to derive inhibitory compounds.

3 Claims, No Drawings

FLEA HEAD, NERVE CORD, HINDGUT AND MALPIGHIAN TUBULE NUCLEIC ACID MOLECULES, PROTEINS AND USES THEREOF

CROSS-REFERENCE TO RELATED APPLICATIONS

This application is a Continuation of U.S. patent Ser. No. 10/621,901, filed Jul. 16, 2003, now abandoned; which claims priority to U.S. Provisional Application Ser. No. 60/319,414, filed Jul. 22, 2002, both of which are entitled "FLEA HEAD, NERVE CORD, HINDGUT MALPHIGIAN TUBULE NUCLEIC ACID MOLECULES, PROTEINS AND USES THEREOF," and incorporated herein by reference in their entirety.

FIELD OF THE INVENTION

The present invention relates to nucleic acid molecules isolated from the head and nerve cord of a flea, nucleic acid molecules isolated from the hindgut and Malpighian tubule of a flea, proteins encoded by such nucleic acid molecules, antibodies raised against such proteins, and inhibitors of such proteins. The present invention also includes therapeutic compositions comprising such nucleic acid molecules, proteins, antibodies, and/or other inhibitors, as well as uses thereof.

BACKGROUND OF THE INVENTION

Flea infestation of animals is a health and economic concern to pet owners. In particular, the bites of fleas are a problem for animals maintained as pets because the infestation becomes a source of annoyance not only for the pet but also for the pet owner who may find his or her home generally contaminated with insects. Fleas are known to directly cause a variety of diseases, including allergies, and also carry a variety of infectious agents including, but not limited to, endoparasites (e.g., nematodes, cestodes, trematodes and protozoa), bacteria and viruses. As such, fleas are a problem not only when they are on an animal but also when they are in the general environment of the animal.

Bites from fleas are a particular problem on many animals because they can cause a hypersensitive response in animals which is manifested as disease. For example, bites from fleas can cause an allergic disease called flea allergic (or allergy) dermatitis (FAD). A hypersensitive response in animals typically results in localized tissue inflammation and damage, causing substantial discomfort to the animal.

The medical importance of flea infestation has prompted the development of reagents capable of controlling flea infestation. Commonly encountered methods to control flea infestation are generally focused on use of insecticides, which are often unsuccessful for one or more of the following reasons: (1) failure of owner compliance (frequent administration is required); (2) behavioral or physiological intolerance of the pet to the pesticide product or means of administration; and (3) the emergence of flea populations resistant to the prescribed dose of pesticide.

Thus, there remains a need to develop a reagent and a method to protect animals from flea infestation.

SUMMARY OF THE INVENTION

The present invention relates to a novel product and process for protection of animals from flea infestation.

The present invention provides flea head and nerve cord (HNC) proteins and flea hindgut and Malpighian tubule (HMT) proteins; nucleic acid molecules encoding flea HNC proteins and flea HMT proteins; antibodies raised against such proteins (i.e., anti-flea HNC antibodies and anti-flea HMT antibodies respectively); mimetopes of such proteins or antibodies; and compounds that inhibit flea HNC or HMT activity (i.e., inhibitory compounds or inhibitors).

The present invention also includes methods to obtain such proteins, mimetopes, nucleic acid molecules, antibodies and inhibitory compounds. The present invention also includes the use of proteins and antibodies to identify such inhibitory compounds as well as assay kits to identify such inhibitory compounds. Also included in the present invention are therapeutic compositions comprising proteins, mimetopes, nucleic acid molecules, antibodies and inhibitory compounds of the present invention including protective compounds derived from a protein of the present invention that inhibit the activity of HNC and/or HMT proteins; also included are uses of such therapeutic compounds to reduce flea infestation.

One embodiment of the present invention is an isolated nucleic acid molecule that hybridizes with a nucleic acid molecule selected from the group consisting of a nucleic acid sequence of Table I and/or Table II, or a nucleic acid sequence complementary to a nucleic acid sequence of Table I and/or Table II under conditions that allow less than or equal to 30% base pair mismatch.

Another embodiment of the present invention is an isolated nucleic acid molecule having a nucleic acid sequence that is at least 70% identical to a nucleic acid sequence of Table I and/or Table II or complements thereof as well as fragments of such sequences.

The present invention also relates to recombinant molecules, recombinant viruses and recombinant cells that include a nucleic acid molecule of the present invention. Also included are methods to produce such nucleic acid molecules, recombinant molecules, recombinant viruses and recombinant cells.

Another embodiment of the present invention includes an isolated flea HMT and/or HNC protein that is at least 70% identical to an amino acid sequence encoded by a nucleic acid sequence of Table I and/or Table U, and fragments thereof wherein such fragments can elicit an immune response against respective flea proteins or have activity comparable to respective flea proteins.

Another embodiment of the present invention includes an isolated protein encoded by a nucleic acid molecule that hybridizes with the complement of a nucleic acid sequence of Table I and/or Table II, under conditions that allow less than or equal to 30% base pair mismatch.

DETAILED DESCRIPTION OF THE INVENTION

The present invention provides for nucleic acid molecules isolated from the head and/or nerve cord of a flea, nucleic acid molecules isolated from the hindgut and/or Malpighian tubule of a flea, proteins encoded by such nucleic acid molecules, antibodies raised against such proteins, and inhibitors of such proteins. As used herein, nucleic acid molecules isolated from the head and/or nerve cord of a flea and proteins encoded by such nucleic acid molecules are also referred to as flea HNC, or HNC, nucleic acid molecules and proteins respectively; and nucleic molecules isolated from the hindgut and/or Malpighian tubules of a flea and proteins encoded by such nucleic acid molecules are referred to as flea HMT or HMT, nucleic acid molecules and proteins respectively. HNC nucleic acid molecules and HMT nucleic acid molecules of the present invention are nucleic acid molecules that are primarily expressed in flea HNC tissues and HMT tissues respectively, but which may be expressed in cells derived from flea tissues other than HNC and HMT. HNC and HMT nucleic acid molecules and proteins of the present invention can be isolated from a flea or prepared recombinantly or synthetically. IMT and HNC nucleic acid molecules of the present invention can be RNA or DNA; examples of nucleic acid molecules include, but are not limited to, complementary DNA (cDNA) molecules, genomic DNA molecules, synthetic DNA molecules, DNA molecules which are specific tags for messenger RNA derived from HMT and HNC tissues, and corresponding mRNA molecules. As such, a flea nucleic acid molecule of the present invention is not intended refer to an entire chromosome within which such a nucleic acid molecule is contained, however, a flea HMT or HNC cDNA of the present invention may include all regions such as regulatory regions that control production of flea peritrophin proteins encoded by such a cDNA (such as, but not limited to, transcription, translation or post-translation control regions) as well as the coding region itself, and any introns or non-translated coding regions. As used herein, the phrases "HMT and/or HNC protein" and "HMT and HNC protein" refer to a protein expressed by a flea HMT tissue, by a flea HNC tissue, or by both flea HMT and HNC tissues. As used herein, the phrases "HMT and/or HNC nucleic acid molecule" and "HMT and HNC nucleic acid molecule" refer to a nucleic acid molecule that can be isolated from a HMT cDNA library, from a HNC cDNA library, or from both libraries, or a gene corresponding thereto.

The present invention also provides for HMT and ENC DNA molecules that are specific tags for messenger RNA molecules derived from HMT and HNC tissues. Such DNA molecules can correspond to an entire or partial sequence of a messenger RNA, and therefore, a DNA molecule corresponding to such a messenger RNA molecule (i.e. a cDNA molecule), can encode a full-length or partial-length protein. A nucleic acid molecule encoding a partial-length protein can be used directly as a probe or indirectly to generate primers to identify and/or isolate a cDNA nucleic acid molecule encoding a corresponding, or structurally related, full-length protein. Such a partial cDNA nucleic acid molecule can also be used in a similar manner to identify a genomic nucleic acid molecule, such as a nucleic acid molecule that contains the complete gene including regulatory regions, exons and introns. Methods for using partial HMT and HNC cDNA molecules and sequences to isolate full-length transcripts and corresponding cDNA molecules are described in the examples herein below.

The proteins and nucleic acid molecules of the present invention can be obtained from their natural source, or can be produced using, for example, recombinant nucleic acid technology or chemical synthesis. Also included in the present invention is the use of these proteins and nucleic acid molecules as well as antibodies and inhibitory compounds thereto as therapeutic compositions to protect animals from flea infestation as well as in other applications, such as those disclosed below.

Flea HMT and HNC proteins and nucleic acid molecules of the present invention have utility because they represent novel targets for anti-arthropod vaccines and chemotherapeutic drugs. The products and processes of the present invention are advantageous because they enable the inhibition of arthropod development, metamorphosis, feeding, digestion and/or reproduction processes that involve HMT and/or ANC proteins.

The head and nerve cord of the flea, including antennae, brain, corpora cardiacum, corpora allata, and subesophageal and abdominal ganglion tissues are of interest as such tissues are highly enriched for transcripts that encode neuronal and endocrine targets, as well as targets involved in chemosensory and mechanosensory reception. By sequencing cDNA fragments from a library enriched in flea head and nerve cord nucleic acid sequences (referred to herein as HNC nucleic acid sequences), genes, and their respective full-length coding regions, integrally involved with flea neuronal and endocrine function are identified. Once identified, these genes can be further characterized and specific interference strategies are designed. As such, flea HNC proteins and nucleic acid molecules of the present invention have utility because they represent novel targets for anti-arthropod vaccines and chemotherapeutic drugs.

Blood-feeding insects such as fleas ingest large quantities of blood relative to their body weight and, as such, are adapted to reduce the volume of the ingested blood meal through the rapid elimination of water. In addition, the concentrations of sodium, potassium, and chloride ions in the blood meal are greater than in the hemolymph of fleas, necessitating the excretion of excessive amounts of these ions. The active transport of these ions from the hemolymph into the lumens of the Malpighian tubules and the hindgut drives the passive transport of water and other hemolymph contents into these organs as well. While passing through these organs, waste products from the hemolymph are excreted and needed nutrients, water, and salts are reabsorbed. As such, interfering with these essential processes is an important strategy for developing a product for controlling flea populations. By sequencing cDNA fragments from a library enriched in hindgut and Malpighian tubule nucleic acid sequences (referred to herein as HMT nucleic acid sequences), genes integrally involved with these processes, and their respective full-length coding regions, are identified. Once identified, these genes are further characterized and specific interference strategies can be designed. As such, flea HMT proteins and nucleic acid molecules of the present invention have utility because they represent novel targets for anti-arthropod vaccines and chemotherapeutic drugs.

One embodiment of the present invention is an isolated protein that includes a flea HMT and/or HNC protein. It is to be noted that the term "a" or "an" entity refers to one or more of that entity; for example, a protein, a nucleic acid molecule, an antibody and a therapeutic composition refers to "one or more" or "at least one" protein, nucleic acid molecule, antibody and therapeutic composition respectively. As such, the terms "a" (or "an"), "one or more" and "at least one" can be used interchangeably herein. It is also to be noted that the terms "comprising", "including", and "having" can be used interchangeably. According to the present invention, an isolated, or biologically pure, protein, is a protein that has been removed from its natural milieu. As such, "isolated" and "biologically pure" do not necessarily reflect the extent to which the protein has been purified. An isolated protein of the present invention can be obtained from its natural source, can be produced using recombinant DNA technology, or can be produced by chemical synthesis.

As used herein, isolated flea IMT and/or HNC proteins of the present invention can be full-length proteins or any homologue of such proteins. An isolated protein of the present invention, including a homologue, can be identified in a straight-forward manner by the protein's ability to elicit an immune response against a flea HMT and/or HNC protein or by the protein's HMT and/or HNC activity. Examples of flea HMT and HNC homologue proteins include flea HMT and HNC proteins in which amino acids have been deleted (e.g., a truncated version of the protein, such as a peptide), inserted, inverted, substituted and/or derivatized (e.g., by glycosylation, phosphorylation, acetylation, myristoylation, prenylation, palmitoylation, amidation and/or addition of glycerophosphatidyl inositol) such that the homologue includes at least one epitope capable of eliciting an immune response against a flea HMT or HNC protein, and/or of binding to an antibody directed against a flea HMT or HNC protein. That is, when the homologue is administered to an animal as an immunogen, using techniques known to those skilled in the art, the animal will produce an immune response against at least one epitope of a natural flea HMT or HNC protein. The ability of a protein to effect an immune response can be measured using techniques known to those skilled in the art. As used herein, the term "epitope" refers to the smallest portion of a protein or other antigen capable of selectively binding to the anti-en binding site of an antibody or a T cell receptor. It is well accepted by those skilled in the art that the minimal size of a protein epitope is about four to six amino acids. As is appreciated by those skilled in the art, an epitope can include amino acids that naturally are contiguous to each other as well as amino acids that, due to the tertiary structure of the natural protein, are in sufficiently close proximity to form an epitope. According to the present invention, an epitope includes a portion of a protein comprising at least 4 amino acids, at least 5 amino acids, at least 6 amino acids, at least 10 amino acids, at least 15 amino acids, at least 20 amino acids, at least 25 amino acids, at least 30 amino acids, at least 35 amino acids, at least 40 amino acids or at least 50 amino acids in length.

In one embodiment of the present invention a flea homologue protein has HMT or HNC activity, i.e. the homologue exhibits an activity similar to its natural counterpart. Methods to detect and measure such activities are known to those skilled in the art.

Flea HMT and/or HNC homologue proteins can be the result of natural allelic variation or natural mutation. Flea HMT and/or HNC protein homologues of the present invention can also be produced using techniques known in the art including, but not limited to, direct modifications to the protein or modifications to the gene encoding the protein using, for example, classic or recombinant DNA techniques to effect random or targeted mutagenesis.

Flea HMT and HNC proteins of the present invention are encoded by flea HMT and HNC nucleic acid molecules, respectively. As used herein, flea HMT and HNC nucleic acid molecules include nucleic acid sequences related to natural flea HMT and HNC genes, and, preferably, to *Ctenocephalides felis* HMT and ENC genes. As used herein, flea HMT and HNC genes include all regions such as regulatory regions that control production of flea HMT and HNC proteins encoded by such genes (such as, but not limited to, transcription, translation or post-translation control regions) as well as the coding region itself, and any introns or non-translated coding regions. As used herein, a nucleic acid molecule that "includes" or "comprises" a sequence may include that sequence in one contiguous array, or may include the sequence as fragmented exons such as its often found for a flea gene. As used herein, the term "coding region" refers to a continuous linear array of nucleotides that translates into a protein. A full-length coding region is that coding region that is translated into a full-length, i.e., a complete protein as would be initially translated in its natural millieu, prior to any post-translational modifications.

TABLE I represents a variety of flea HNC nucleic acid molecules of the present invention.

| SEQ ID NO | Name |
|---|---|
| 1 | 2227-82HNC |
| 2 | 2228-51HNC |
| 3 | 2229-06HNC |
| 4 | 2229-42HNC |
| 5 | 2245-07HNC |
| 6 | 2245-93HNC |
| 7 | 2247-04HNC |
| 8 | 2229-44HNC |
| 9 | 2249-09HNC |
| 10 | 2249-10HNC |
| 11 | 2251-09HNC |
| 12 | 2215-13HNC |
| 13 | 2218-39HNC |
| 14 | 2218-82HNC |

TABLE II represents a variety of flea HMT nucleic acid molecules of the present invention.

| SEQ ID NO: | Name |
|---|---|
| 15 | 2084-03HMT |
| 16 | 2084-27HMT |
| 17 | 2084-41HMT |
| 18 | 2084-45HMT |
| 19 | 2084-47HMT |
| 20 | 2084-49HMT |
| 21 | 2084-51HMT |
| 22 | 2085-10HMT |
| 23 | 2085-23HMT |
| 24 | 2085-25HMT |
| 25 | 2085-41HMT |
| 26 | 2085-57HMT |
| 27 | 2086-22HMT |
| 28 | 2087-18HMT |
| 29 | 2088-24HMT |
| 30 | 2088-27HMT |
| 31 | 2088-30HMT |
| 32 | 2088-51HMT |
| 33 | 2088-53HMT |
| 34 | 2089-52HMT |
| 35 | 2091-32HMT |
| 36 | 2091-62HMT |
| 37 | 2092-34HMT |
| 38 | 2093-57HMT |
| 39 | 2094-14HMT |
| 40 | 2094-18HMT |
| 41 | 2094-46HMT |
| 42 | 2094-61HMT |
| 43 | 2095-14HMT |
| 44 | 2095-25HMT |
| 45 | 2095-50HMT |
| 46 | 2102-06HMT |
| 47 | 2102-25HMT |
| 48 | 2102-26HMT |
| 49 | 2103-15HMT |
| 50 | 2104-14HMT |
| 51 | 2104-16HMT |
| 52 | 2105-04HMT |
| 53 | 2105-07HMT |
| 54 | 2105-25HMT |
| 55 | 2105-41HMT |
| 56 | 2106-10HMT |
| 57 | 2107-21HMT |
| 58 | 2107-36HMT |
| 59 | 2108-08HMT |
| 60 | 2108-12HMT |
| 61 | 2108-22HMT |
| 62 | 2124-03HMT |
| 63 | 2154-17HMT |
| 64 | 2154-18HMT |

TABLE II-continued represents a variety of flea HMT nucleic acid molecules of the present invention.

| SEQ ID NO: | Name |
|---|---|
| 65 | 2154-49HMT |
| 66 | 2154-52HMT |
| 67 | 2154-55HMT |
| 68 | 2154-57HMT |
| 69 | 2156-05HMT |
| 70 | 2156-57HMT |
| 71 | 2157-40HMT |
| 72 | 2158-08HMT |
| 73 | 2158-20HMT |
| 74 | 2158-78HMT |
| 75 | 2159-78HMT |
| 76 | 2160-38HMT |
| 77 | 2160-87HMT |
| 78 | 2162-16HMT |
| 79 | 2162-20HMT |
| 80 | 2162-74HMT |
| 81 | 2166-25HMT |
| 82 | 2167-46HMT |
| 83 | 2169-34HMT |
| 84 | 2171-31HMT |
| 85 | 2171-81HMT |
| 86 | 2173-28HMT |
| 87 | 2173-61HMT |
| 88 | 2175-12HMT |
| 89 | 2175-26HMT |
| 90 | 2175-77HMT |
| 91 | 2177-26HMT |
| 92 | 2177-42HMT |
| 93 | 2177-50HMT |
| 94 | 2177-82HMT |
| 95 | 2181-65HMT |
| 96 | 2181-85HMT |
| 97 | 2183-34HMT |
| 98 | 2183-77HMT |
| 99 | 2183-90HMT |
| 100 | 2187-45HMT |
| 101 | 2188-28HMT |
| 102 | 2188-75HMT |
| 103 | 2191-26HMT |
| 104 | 2191-66HMT |
| 105 | 2192-23HMT |
| 106 | 2192-42HMT |
| 107 | 2193-50HMT |
| 108 | 2194-30HMT |
| 109 | 2194-37HMT |
| 110 | 2195-34HMT |
| 111 | 2195-80HMT |
| 112 | 2196-04HMT |
| 113 | 2196-29HMT |
| 114 | 2197-24HMT |
| 115 | 2202-47HMT |
| 116 | 2205-78HMT |
| 117 | 2253-02HMT |
| 118 | 2253-05HMT |
| 119 | 2253-07HMT |
| 120 | 2253-21HMT |
| 121 | 2253-73HMT |
| 122 | 2253-82HMT |
| 123 | 2253-83HMT |
| 124 | 2253-84HMT |
| 125 | 2253-96HMT |
| 126 | 2254-23HMT |
| 127 | 2254-24HMT |
| 128 | 2254-29HMT |
| 129 | 2254-40HMT |
| 130 | 2254-53HMT |
| 131 | 2254-57HMT |
| 132 | 2254-71HMT |
| 133 | 2254-85HMT |
| 134 | 2254-87HMT |
| 135 | 2254-92HMT |
| 136 | 2255-14HMT |
| 137 | 2255-15HMT |
| 138 | 2255-20HMT |
| 139 | 2255-21HMT |
| 140 | 2255-34HMT |
| 141 | 2255-52HMT |
| 142 | 2255-61HMT |
| 143 | 2255-72HMT |
| 144 | 2255-80HMT |
| 145 | 2256-05HMT |
| 146 | 2085-58HMT |
| 147 | 2086-20HMT |
| 148 | 2086-53HMT |
| 149 | 2087-06HMT |
| 150 | 2088-05HMT |
| 151 | 2088-17HMT |
| 152 | 2089-10HMT |
| 153 | 2092-40HMT |
| 154 | 2094-33HMT |
| 155 | 2094-47HMT |
| 156 | 2103-28HMT |
| 157 | 2103-58HMT |
| 158 | 2104-23HMT |
| 159 | 2104-59HMT |
| 160 | 2105-09HMT |
| 161 | 2106-14HMT |
| 162 | 2156-03HMT |
| 163 | 2156-14HMT |
| 164 | 2161-46HMT |
| 165 | 2162-93HMT |
| 166 | 2175-18HMT |
| 167 | 2185-19HMT |
| 168 | 2191-92HMT |
| 169 | 2195-06HMT |
| 170 | 2196-61HMT |
| 171 | 2253-13HMT |
| 172 | 2253-16HMT |
| 173 | 2253-19HMT |
| 174 | 2253-27HMT |
| 175 | 2253-40HMT |
| 176 | 2253-56HMT |
| 177 | 2253-68HMT |
| 178 | 2253-78HMT |
| 179 | 2253-87HMT |
| 180 | 2253-92HMT |
| 181 | 2254-43HMT |
| 182 | 2254-45HMT |
| 183 | 2254-51HMT |
| 184 | 2254-54HMT |
| 185 | 2254-66HMT |
| 186 | 2254-88HMT |
| 187 | 2254-96HMT |
| 188 | 2255-17HMT |
| 189 | 2255-19HMT |
| 190 | 2255-23HMT |
| 191 | 2255-25HMT |
| 192 | 2255-32HMT |
| 193 | 2255-39HMT |
| 194 | 2255-41HMT |
| 195 | 2255-45HMT |
| 196 | 2255-60HMT |
| 197 | 2255-62HMT |
| 198 | 2255-67HMT |
| 199 | 2255-77HMT |
| 200 | 2255-79HMT |
| 201 | 2255-82HMT |
| 202 | 2256-12HMT |
| 203 | 2256-22HMT |
| 204 | 2256-46HMT |
| 205 | 2256-54HMT |
| 206 | 2256-58HMT |
| 207 | 2256-64HMT |
| 208 | 2229-13HMT |
| 209 | 2229-17HMT |
| 210 | 2229-20HMT |
| 211 | 2229-31HMT |
| 212 | 2229-33HMT |
| 213 | 2229-34HMT |
| 214 | 2232-63HMT |

TABLE II-continued represents a variety of flea HMT nucleic acid molecules of the present invention.

| SEQ ID NO: | Name |
| --- | --- |
| 215 | 2232-70HMT |
| 216 | 2232-81HMT |
| 217 | 2232-96HMT |
| 218 | 2233-03HMT |
| 219 | 2233-04HMT |
| 220 | 2233-09HMT |
| 221 | 2233-14HMT |
| 222 | 2233-20HMT |
| 223 | 2233-33HMT |
| 224 | 2233-38HMT |
| 225 | 2233-39HMT |
| 226 | 2233-45HMT |
| 227 | 2233-54HMT |
| 228 | 2233-56HMT |
| 229 | 2233-60HMT |
| 230 | 2233-64HMT |
| 231 | 2233-70HMT |
| 232 | 2233-71HMT |
| 233 | 2233-75HMT |
| 234 | 2233-76HMT |
| 235 | 2233-77HMT |
| 236 | 2233-92HMT |
| 237 | 2233-95HMT |
| 238 | 2234-08HMT |
| 239 | 2234-15HMT |
| 240 | 2234-17HMT |
| 241 | 2234-18HMT |
| 242 | 2234-30HMT |
| 243 | 2234-33HMT |
| 244 | 2234-35HMT |
| 245 | 2234-37HMT |
| 246 | 2234-57HMT |
| 247 | 2234-65HMT |
| 248 | 2240-04HMT |
| 249 | 2241-07HMT |
| 250 | 2241-08HMT |
| 251 | 2241-09HMT |
| 252 | 2229-71HMT |
| 253 | 2229-86HMT |
| 254 | 2230-04HMT |
| 255 | 2230-09HMT |
| 256 | 2230-12HMT |
| 257 | 2230-13HMT |
| 258 | 2230-30HMT |
| 259 | 2230-31HMT |
| 260 | 2230-36HMT |
| 261 | 2230-40HMT |
| 262 | 2230-42HMT |
| 263 | 2230-44HMT |
| 264 | 2230-45HMT |
| 265 | 2230-61HMT |
| 266 | 2230-63HMT |
| 267 | 2230-68HMT |
| 268 | 2230-70HMT |
| 269 | 2230-72HMT |
| 270 | 2230-76HMT |
| 271 | 2230-78HMT |
| 272 | 2230-86HMT |
| 273 | 2230-92HMT |
| 274 | 2231-05HMT |
| 275 | 2231-06HMT |
| 276 | 2231-09HMT |
| 277 | 2231-12HMT |
| 278 | 2231-17HMT |
| 279 | 2231-30HMT |
| 280 | 2231-34HMT |
| 281 | 2231-45HMT |
| 282 | 2231-96HMT |
| 283 | 2232-07HMT |
| 284 | 2232-09HMT |
| 285 | 2232-13HMT |
| 286 | 2232-23HMT |
| 287 | 2232-31HMT |
| 288 | 2232-35HMT |
| 289 | 2232-40HMT |
| 290 | 2232-46HMT |
| 291 | 2232-54HMT |
| 292 | 2229-51HMT |
| 293 | 2230-60HMT |
| 294 | 2230-81HMT |
| 295 | 2231-03HMT |
| 296 | 2231-24HMT |
| 297 | 2231-56HMT |
| 298 | 2233-59HMT |
| 299 | 2234-12HMT |
| 300 | 2234-76HMT |
| 301 | 2234-86HMT |
| 302 | 2240-11HMT |
| 303 | 2240-14HMT |
| 304 | 2240-17HMT |
| 305 | 2240-23HMT |
| 306 | 2240-26HMT |
| 307 | 2240-28HMT |
| 308 | 2240-31HMT |
| 309 | 2240-44HMT |
| 310 | 2240-63HMT |
| 311 | 2240-66HMT |
| 312 | 2240-70HMT |
| 313 | 2240-72HMT |
| 314 | 2240-94HMT |
| 315 | 2241-10HMT |
| 316 | 2241-12HMT |
| 317 | 2241-40HMT |
| 318 | 2241-54HMT |
| 319 | 2241-56HMT |
| 320 | 2241-60HMT |
| 321 | 2241-66HMT |
| 322 | 2241-74HMT |
| 323 | 2241-82HMT |
| 324 | 2241-83HMT |
| 325 | 2241-86HMT |
| 326 | 2241-87HMT |
| 327 | 2243-10HMT |
| 328 | 2243-18HMT |
| 329 | 2243-20HMT |
| 330 | 2243-22HMT |
| 331 | 2243-27HMT |
| 332 | 2243-28HMT |
| 333 | 2243-31HMT |
| 334 | 2243-32HMT |
| 335 | 2243-38HMT |
| 336 | 2243-41HMT |
| 337 | 2243-45HMT |
| 338 | 2243-48HMT |
| 339 | 2243-52HMT |
| 340 | 2243-73HMT |
| 341 | 2243-86HMT |
| 342 | 2243-87HMT |
| 343 | 2243-94HMT |
| 344 | 2244-12HMT |
| 345 | 2244-25HMT |
| 346 | 2244-29HMT |
| 347 | 2244-44HMT |
| 348 | 2244-54HMT |
| 349 | 2244-71HMT |
| 350 | 2244-75HMT |
| 351 | 2084-19 |
| 352 | 2084-25 |
| 353 | 2084-57 |
| 354 | 2084-58 |
| 355 | 2084-64 |
| 356 | 2085-06 |
| 357 | 2085-12 |
| 358 | 2085-27 |
| 359 | 2085-28 |
| 360 | 2086-08 |
| 361 | 2086-14 |
| 362 | 2086-16 |
| 363 | 2086-21 |
| 364 | 2086-23 |

TABLE II-continued represents a variety of flea HMT nucleic acid molecules of the present invention.

| SEQ ID NO: | Name |
|---|---|
| 365 | 2086-46 |
| 366 | 2086-51 |
| 367 | 2086-56 |
| 368 | 2086-57 |
| 369 | 2086-59 |
| 370 | 2086-62 |
| 371 | 2087-05 |
| 372 | 2087-16 |
| 373 | 2087-19 |
| 374 | 2087-24 |
| 375 | 2087-53 |
| 376 | 2087-55 |
| 377 | 2088-06 |
| 378 | 2088-08 |
| 379 | 2088-12 |
| 380 | 2088-13 |
| 381 | 2088-14 |
| 382 | 2088-16 |
| 383 | 2088-18 |
| 384 | 2088-23 |
| 385 | 2088-28 |
| 386 | 2088-34 |
| 387 | 2088-42 |
| 388 | 2088-44 |
| 389 | 2088-45 |
| 390 | 2088-50 |
| 391 | 2089-04 |
| 392 | 2089-15 |
| 393 | 2089-16 |
| 394 | 2089-17 |
| 395 | 2089-18 |
| 396 | 2089-19 |
| 397 | 2089-24 |
| 398 | 2089-31 |
| 399 | 2089-38 |
| 400 | 2089-40 |
| 401 | 2089-41 |
| 402 | 2089-53 |
| 403 | 2089-58 |
| 404 | 2090-02 |
| 405 | 2090-12 |
| 406 | 2090-16 |
| 407 | 2090-29 |
| 408 | 2090-37 |
| 409 | 2090-39 |
| 410 | 2090-41 |
| 411 | 2090-50 |
| 412 | 2090-52 |
| 413 | 2090-56 |
| 414 | 2091-09 |
| 415 | 2091-15 |
| 416 | 2091-16 |
| 417 | 2091-18 |
| 418 | 2091-24 |
| 419 | 2091-25 |
| 420 | 2091-28 |
| 421 | 2091-52 |
| 422 | 2092-02 |
| 423 | 209206- |
| 424 | 2092-08 |
| 425 | 2092-15 |
| 426 | 2092-22 |
| 427 | 2092-24 |
| 428 | 2092-26 |
| 429 | 2092-30 |
| 430 | 2092-35 |
| 431 | 2092-53 |
| 432 | 2092-55 |
| 433 | 2092-63 |
| 434 | 2093-11 |
| 435 | 2093-19 |
| 436 | 2093-24 |
| 437 | 2093-27 |
| 438 | 2093-28 |
| 439 | 2093-33 |
| 440 | 2093-36 |
| 441 | 2093-37 |
| 442 | 2093-38 |
| 443 | 2093-40 |
| 444 | 2093-51 |
| 445 | 2093-52 |
| 446 | 2093-53 |
| 447 | 2093-55 |
| 448 | 2093-56 |
| 449 | 2093-60 |
| 450 | 2094-02 |
| 451 | 2094-04 |
| 452 | 2094-06 |
| 453 | 2094-09 |
| 454 | 2094-10 |
| 455 | 2094-13 |
| 456 | 2094-15 |
| 457 | 2094-23 |
| 458 | 2094-27 |
| 459 | 2094-29 |
| 460 | 2094-34 |
| 461 | 2094-37 |
| 462 | 2094-39 |
| 463 | 2094-41 |
| 464 | 2094-45 |
| 465 | 2094-49 |
| 466 | 2094-51 |
| 467 | 2094-53 |
| 468 | 2094-54 |
| 469 | 2094-59 |
| 470 | 2095-02 |
| 471 | 2095-07 |
| 472 | 2095-16 |
| 473 | 2095-19 |
| 474 | 2095-21 |
| 475 | 2095-24 |
| 476 | 2095-32 |
| 477 | 2095-35 |
| 478 | 2095-37 |
| 479 | 2095-39 |
| 480 | 2095-42 |
| 481 | 2095-44 |
| 482 | 2095-46 |
| 483 | 2095-49 |
| 484 | 2095-53 |
| 485 | 2095-56 |
| 486 | 2095-58 |
| 487 | 2095-61 |
| 488 | 2095-62 |
| 489 | 2095-64 |
| 490 | 2102-03 |
| 491 | 2102-04 |
| 492 | 2102-05 |
| 493 | 2102-07 |
| 494 | 2102-08 |
| 495 | 2102-10 |
| 496 | 2102-14 |
| 497 | 2102-15 |
| 498 | 2102-31 |
| 499 | 2102-34 |
| 500 | 2102-39 |
| 501 | 2102-40 |
| 502 | 2102-42 |
| 503 | 2102-43 |
| 504 | 2102-52 |
| 505 | 2102-56 |
| 506 | 2102-57 |
| 507 | 2102-62 |
| 508 | 2103-04 |
| 509 | 2103-06 |
| 510 | 2103-07 |
| 511 | 2103-10 |
| 512 | 2103-16 |
| 513 | 2103-18 |
| 514 | 2103-19 |

TABLE II-continued represents a variety of flea HMT nucleic acid molecules of the present invention.

| SEQ ID NO: | Name |
|---|---|
| 515 | 2103-20 |
| 516 | 2103-21 |
| 517 | 2103-22 |
| 518 | 2103-23 |
| 519 | 2103-25 |
| 520 | 2103-26 |
| 521 | 2103-32 |
| 522 | 2103-34 |
| 523 | 2103-36 |
| 524 | 2103-38 |
| 525 | 2103-39 |
| 526 | 2103-42 |
| 527 | 2103-43 |
| 528 | 2103-46 |
| 529 | 2103-51 |
| 530 | 2103-52 |
| 531 | 2103-54 |
| 532 | 2103-59 |
| 533 | 2103-64 |
| 534 | 2104-02 |
| 535 | 2104-09 |
| 536 | 2104-11 |
| 537 | 2104-12 |
| 538 | 2104-17 |
| 539 | 2104-19 |
| 540 | 2104-27 |
| 541 | 2104-30 |
| 542 | 2104-33 |
| 543 | 2104-36 |
| 544 | 2104-37 |
| 545 | 2104-39 |
| 546 | 2104-42 |
| 547 | 2104-49 |
| 548 | 2104-52 |
| 549 | 2104-53 |
| 550 | 2104-57 |
| 551 | 2104-62 |
| 552 | 2105-03 |
| 553 | 2105-05 |
| 554 | 2105-06 |
| 555 | 2105-08 |
| 556 | 2105-13 |
| 557 | 2105-22 |
| 558 | 2105-24 |
| 559 | 2105-26 |
| 560 | 2105-27 |
| 561 | 2105-29 |
| 562 | 2105-30 |
| 563 | 2105-36 |
| 564 | 2105-39 |
| 565 | 2105-47 |
| 566 | 2105-49 |
| 567 | 2105-52 |
| 568 | 2105-58 |
| 569 | 2105-59 |
| 570 | 2105-60 |
| 571 | 2106-03 |
| 572 | 2106-05 |
| 573 | 2106-06 |
| 574 | 2106-08 |
| 575 | 2106-13 |
| 576 | 2106-22 |
| 577 | 2106-24 |
| 578 | 2106-26 |
| 579 | 2106-27 |
| 580 | 2106-29 |
| 581 | 2106-30 |
| 582 | 2106-36 |
| 583 | 2106-39 |
| 584 | 2106-47 |
| 585 | 2106-49 |
| 586 | 2106-52 |
| 587 | 2106-58 |
| 588 | 2106-59 |
| 589 | 2106-60 |
| 590 | 2107-05 |
| 591 | 2107-07 |
| 592 | 2107-08 |
| 593 | 2107-14 |
| 594 | 2107-20 |
| 595 | 2107-23 |
| 596 | 2107-27 |
| 597 | 2107-31 |
| 598 | 2107-33 |
| 599 | 2107-34 |
| 600 | 2107-35 |
| 601 | 2107-42 |
| 602 | 2107-44 |
| 603 | 2107-47 |
| 604 | 2107-48 |
| 605 | 2107-49 |
| 606 | 2107-51 |
| 607 | 2107-53 |
| 608 | 2107-56 |
| 609 | 2107-60 |
| 610 | 2107-62 |
| 611 | 2107-63 |
| 612 | 2108-15 |
| 613 | 2108-16 |
| 614 | 2108-18 |
| 615 | 2108-20 |
| 616 | 2108-24 |
| 617 | 2108-25 |
| 618 | 2108-30 |
| 619 | 2108-32 |
| 620 | 2108-33 |
| 621 | 2108-34 |
| 622 | 2108-43 |
| 623 | 2108-45 |
| 624 | 2108-50 |
| 625 | 2108-55 |
| 626 | 2108-61 |
| 627 | 2108-62 |
| 628 | 2109-03 |
| 629 | 2109-05 |
| 630 | 2109-09 |
| 631 | 2109-11 |
| 632 | 2109-12 |
| 633 | 2109-14 |
| 634 | 2109-15 |
| 635 | 2109-17 |
| 636 | 2109-20 |
| 637 | 2109-22 |
| 638 | 2109-23 |
| 639 | 2109-25 |
| 640 | 2109-27 |
| 641 | 2109-29 |
| 642 | 2109-32 |
| 643 | 2109-33 |
| 644 | 2109-34 |
| 645 | 2109-36 |
| 646 | 2109-41 |
| 647 | 2109-43 |
| 648 | 2109-45 |
| 649 | 2109-46 |
| 650 | 2109-48 |
| 651 | 2109-49 |
| 652 | 2109-50 |
| 653 | 2109-57 |
| 654 | 2109-60 |
| 655 | 2109-61 |
| 656 | 2109-62 |
| 657 | 2109-63 |
| 658 | 2154-02 |
| 659 | 2154-03 |
| 660 | 2154-05 |
| 661 | 2154-07 |
| 662 | 2154-12 |
| 663 | 2154-13 |
| 664 | 2154-14 |

TABLE II-continued represents a variety of flea HMT nucleic acid molecules of the present invention.

| SEQ ID NO: | Name |
|---|---|
| 665 | 2154-15 |
| 666 | 2154-19 |
| 667 | 2154-22 |
| 668 | 2154-26 |
| 669 | 2154-35 |
| 670 | 2154-37 |
| 671 | 2154-39 |
| 672 | 2154-40 |
| 673 | 2154-44 |
| 674 | 2154-53 |
| 675 | 2154-59 |
| 676 | 2154-62 |
| 677 | 2154-63 |
| 678 | 2154-67 |
| 679 | 2154-69 |
| 680 | 2154-88 |
| 681 | 2156-04 |
| 682 | 2156-08 |
| 683 | 2156-13 |
| 684 | 2156-16 |
| 685 | 2156-19 |
| 686 | 2156-20 |
| 687 | 2156-22 |
| 688 | 2156-24 |
| 689 | 2156-25 |
| 690 | 2156-30 |
| 691 | 2156-31 |
| 692 | 2156-32 |
| 693 | 2156-33 |
| 694 | 2156-35 |
| 695 | 2156-39 |
| 696 | 2156-45 |
| 697 | 2156-46 |
| 698 | 2156-49 |
| 699 | 2156-55 |
| 700 | 2156-61 |
| 701 | 2156-64 |
| 702 | 2157-03 |
| 703 | 2157-04 |
| 704 | 2157-07 |
| 705 | 2157-09 |
| 706 | 2157-13 |
| 707 | 2157-17 |
| 708 | 2157-18 |
| 709 | 2157-19 |
| 710 | 2157-22 |
| 711 | 2157-23 |
| 712 | 2157-24 |
| 713 | 2157-25 |
| 714 | 2157-26 |
| 715 | 2157-28 |
| 716 | 2157-35 |
| 717 | 2157-37 |
| 718 | 2157-38 |
| 719 | 2157-41 |
| 720 | 2157-42 |
| 721 | 2157-46 |
| 722 | 2157-49 |
| 723 | 2157-50 |
| 724 | 2157-52 |
| 725 | 2157-57 |
| 726 | 2157-63 |
| 727 | 2157-65 |
| 728 | 2157-71 |
| 729 | 2157-72 |
| 730 | 2157-74 |
| 731 | 2157-75 |
| 732 | 2157-80 |
| 733 | 2157-93 |
| 734 | 2158-08 |
| 735 | 2158-10 |
| 736 | 2158-13 |
| 737 | 2158-15 |
| 738 | 2158-16 |
| 739 | 2158-20 |
| 740 | 2158-26 |
| 741 | 2158-32 |
| 742 | 2158-38 |
| 743 | 2158-40 |
| 744 | 2158-43 |
| 745 | 2158-44 |
| 746 | 2158-45 |
| 747 | 2158-46 |
| 748 | 2159-16 |
| 749 | 2159-18 |
| 750 | 2159-24 |
| 751 | 2159-26 |
| 752 | 2159-28 |
| 753 | 2159-33 |
| 754 | 2159-37 |
| 755 | 2159-38 |
| 756 | 2159-40 |
| 757 | 2159-42 |
| 758 | 2159-43 |
| 759 | 2159-44 |
| 760 | 2159-45 |
| 761 | 2159-46 |
| 762 | 2159-50 |
| 763 | 2159-52 |
| 764 | 2159-61 |
| 765 | 2159-62 |
| 766 | 2159-65 |
| 767 | 2159-67 |
| 768 | 2159-70 |
| 769 | 2159-71 |
| 770 | 2159-72 |
| 771 | 2159-73 |
| 772 | 2159-74 |
| 773 | 2159-80 |
| 774 | 2159-83 |
| 775 | 2159-86 |
| 776 | 2159-89 |
| 777 | 2159-90 |
| 778 | 2159-93 |
| 779 | 2159-95 |
| 780 | 2160-04 |
| 781 | 2160-05 |
| 782 | 2160-08 |
| 783 | 2160-10 |
| 784 | 2160-15 |
| 785 | 2160-20 |
| 786 | 2160-22 |
| 787 | 2160-24 |
| 788 | 2160-33 |
| 789 | 2160-37 |
| 790 | 2160-40 |
| 791 | 2160-41 |
| 792 | 2160-43 |
| 793 | 2160-46 |
| 794 | 2160-51 |
| 795 | 2160-52 |
| 796 | 2160-56 |
| 797 | 2160-57 |
| 798 | 2160-64 |
| 799 | 2160-66 |
| 800 | 2160-72 |
| 801 | 2160-73 |
| 802 | 2160-76 |
| 803 | 2160-78 |
| 804 | 2160-92 |
| 805 | 2160-94 |
| 806 | 2160-95 |
| 807 | 2160-96 |
| 808 | 2161-02 |
| 809 | 2161-22 |
| 810 | 2161-24 |
| 811 | 2161-25 |
| 812 | 2161-26 |
| 813 | 2161-27 |
| 814 | 2161-29 |

TABLE II-continued represents a variety of flea HMT nucleic acid molecules of the present invention.

| SEQ ID NO: | Name |
|---|---|
| 815 | 2161-30 |
| 816 | 2161-31 |
| 817 | 2161-32 |
| 818 | 2161-33 |
| 819 | 2161-36 |
| 820 | 2161-41 |
| 821 | 2161-42 |
| 822 | 2161-50 |
| 823 | 2161-51 |
| 824 | 2161-53 |
| 825 | 2161-55 |
| 826 | 2161-61 |
| 827 | 2161-63 |
| 828 | 2161-66 |
| 829 | 2161-68 |
| 830 | 2161-71 |
| 831 | 2161-73 |
| 832 | 2161-84 |
| 833 | 2162-04 |
| 834 | 2162-07 |
| 835 | 2162-09 |
| 836 | 2162-10 |
| 837 | 2162-14 |
| 838 | 2162-15 |
| 839 | 2162-17 |
| 840 | 2162-19 |
| 841 | 2162-22 |
| 842 | 2162-23 |
| 843 | 2162-27 |
| 844 | 2162-29 |
| 845 | 2162-37 |
| 846 | 2162-39 |
| 847 | 2162-43 |
| 848 | 2162-51 |
| 849 | 2162-52 |
| 850 | 2162-54 |
| 851 | 2162-55 |
| 852 | 2162-56 |
| 853 | 2162-57 |
| 854 | 2162-58 |
| 855 | 2162-60 |
| 856 | 2162-61 |
| 857 | 2162-65 |
| 858 | 2162-67 |
| 859 | 2162-70 |
| 860 | 2162-76 |
| 861 | 2162-77 |
| 862 | 2162-79 |
| 863 | 2162-82 |
| 864 | 2162-84 |
| 865 | 2162-85 |
| 866 | 2162-86 |
| 867 | 2162-89 |
| 868 | 2162-90 |
| 869 | 2162-94 |
| 870 | 2163-05 |
| 871 | 2163-06 |
| 872 | 2163-08 |
| 873 | 2163-09 |
| 874 | 2163-10 |
| 875 | 2163-12 |
| 876 | 2163-13 |
| 877 | 2163-14 |
| 878 | 2163-15 |
| 879 | 2163-16 |
| 880 | 2163-17 |
| 881 | 2163-19 |
| 882 | 2163-20 |
| 883 | 2163-30 |
| 884 | 2163-33 |
| 885 | 2163-34 |
| 886 | 2163-35 |
| 887 | 2163-37 |
| 888 | 2163-38 |
| 889 | 2163-39 |
| 890 | 2163-40 |
| 891 | 2163-41 |
| 892 | 2163-46 |
| 893 | 2163-47 |
| 894 | 2163-59 |
| 895 | 2163-63 |
| 896 | 2163-66 |
| 897 | 2163-67 |
| 898 | 2163-68 |
| 899 | 2163-69 |
| 900 | 2163-70 |
| 901 | 2163-72 |
| 902 | 2163-74 |
| 903 | 2163-75 |
| 904 | 2163-80 |
| 905 | 2163-88 |
| 906 | 2163-96 |
| 907 | 2164-02 |
| 908 | 2164-03 |
| 909 | 2164-04 |
| 910 | 2164-05 |
| 911 | 2164-06 |
| 912 | 2164-09 |
| 913 | 2164-10 |
| 914 | 2164-11 |
| 915 | 2164-12 |
| 916 | 2164-14 |
| 917 | 2164-15 |
| 918 | 2164-17 |
| 919 | 2164-20 |
| 920 | 2164-21 |
| 921 | 2164-22 |
| 922 | 2164-23 |
| 923 | 2164-26 |
| 924 | 2164-27 |
| 925 | 2164-28 |
| 926 | 2164-29 |
| 927 | 2164-30 |
| 928 | 2164-31 |
| 929 | 2164-32 |
| 930 | 2164-33 |
| 931 | 2164-34 |
| 932 | 2164-36 |
| 933 | 2164-37 |
| 934 | 2164-41 |
| 935 | 2164-42 |
| 936 | 2164-44 |
| 937 | 2164-46 |
| 938 | 2164-48 |
| 939 | 2164-49 |
| 940 | 2164-50 |
| 941 | 2164-51 |
| 942 | 2164-52 |
| 943 | 2164-53 |
| 944 | 2164-54 |
| 945 | 2164-56 |
| 946 | 2164-57 |
| 947 | 2164-58 |
| 948 | 2164-59 |
| 949 | 2164-61 |
| 950 | 2164-62 |
| 951 | 2164-68 |
| 952 | 2164-69 |
| 953 | 2164-70 |
| 954 | 2164-71 |
| 955 | 2164-72 |
| 956 | 2164-73 |
| 957 | 2164-74 |
| 958 | 2164-75 |
| 959 | 2164-77 |
| 960 | 2164-78 |
| 961 | 2164-79 |
| 962 | 2164-80 |
| 963 | 2164-81 |
| 964 | 2164-83 |

TABLE II-continued represents a variety of flea HMT nucleic acid molecules of the present invention.

| SEQ ID NO: | Name |
|---|---|
| 965 | 2164-84 |
| 966 | 2164-85 |
| 967 | 2164-86 |
| 968 | 2164-87 |
| 969 | 2164-88 |
| 970 | 2164-89 |
| 971 | 2164-91 |
| 972 | 2164-92 |
| 973 | 2164-93 |
| 974 | 2164-94 |
| 975 | 2164-95 |
| 976 | 2164-96 |
| 977 | 2165-02 |
| 978 | 2165-03 |
| 979 | 2165-07 |
| 980 | 2165-09 |
| 981 | 2165-10 |
| 982 | 2165-11 |
| 983 | 2165-13 |
| 984 | 2165-15 |
| 985 | 2165-19 |
| 986 | 2165-22 |
| 987 | 2165-23 |
| 988 | 2165-25 |
| 989 | 2165-29 |
| 990 | 2165-34 |
| 991 | 2165-38 |
| 992 | 2165-39 |
| 993 | 2165-40 |
| 994 | 2165-43 |
| 995 | 2165-44 |
| 996 | 2165-46 |
| 997 | 2165-49 |
| 998 | 2165-50 |
| 999 | 2165-51 |
| 1000 | 2165-52 |
| 1001 | 2165-53 |
| 1002 | 2165-55 |
| 1003 | 2165-61 |
| 1004 | 2165-62 |
| 1005 | 2165-71 |
| 1006 | 2165-72 |
| 1007 | 2165-73 |
| 1008 | 2165-75 |
| 1009 | 2165-77 |
| 1010 | 2165-78 |
| 1011 | 2165-79 |
| 1012 | 2165-80 |
| 1013 | 2165-81 |
| 1014 | 2165-91 |
| 1015 | 2165-92 |
| 1016 | 2165-93 |
| 1017 | 2165-95 |
| 1018 | 2165-96 |
| 1019 | 2166-04 |
| 1020 | 2166-06 |
| 1021 | 2166-07 |
| 1022 | 2166-08 |
| 1023 | 2166-13 |
| 1024 | 2166-14 |
| 1025 | 2166-16 |
| 1026 | 2166-18 |
| 1027 | 2166-20 |
| 1028 | 2166-30 |
| 1029 | 2166-34 |
| 1030 | 2166-36 |
| 1031 | 2166-37 |
| 1032 | 2166-38 |
| 1033 | 2166-39 |
| 1034 | 2166-43 |
| 1035 | 2166-45 |
| 1036 | 2166-48 |
| 1037 | 2166-49 |
| 1038 | 2166-52 |
| 1039 | 2166-54 |
| 1040 | 2166-55 |
| 1041 | 2166-57 |
| 1042 | 2166-59 |
| 1043 | 2166-63 |
| 1044 | 2166-66 |
| 1045 | 2166-67 |
| 1046 | 2166-68 |
| 1047 | 2166-69 |
| 1048 | 2166-70 |
| 1049 | 2166-72 |
| 1050 | 2166-74 |
| 1051 | 2166-85 |
| 1052 | 2166-86 |
| 1053 | 2167-02 |
| 1054 | 2167-06 |
| 1055 | 2167-08 |
| 1056 | 2167-11 |
| 1057 | 2167-12 |
| 1058 | 2167-17 |
| 1059 | 2167-19 |
| 1060 | 2167-21 |
| 1061 | 2167-22 |
| 1062 | 2167-23 |
| 1063 | 2167-24 |
| 1064 | 2167-27 |
| 1065 | 2167-29 |
| 1066 | 2167-30 |
| 1067 | 2167-32 |
| 1068 | 2167-34 |
| 1069 | 2167-37 |
| 1070 | 2167-38 |
| 1071 | 2167-39 |
| 1072 | 2167-41 |
| 1073 | 2167-43 |
| 1074 | 2167-50 |
| 1075 | 2167-54 |
| 1076 | 2167-55 |
| 1077 | 2167-57 |
| 1078 | 2167-58 |
| 1079 | 2167-64 |
| 1080 | 2167-65 |
| 1081 | 2167-71 |
| 1082 | 2167-72 |
| 1083 | 2167-73 |
| 1084 | 2167-74 |
| 1085 | 2167-75 |
| 1086 | 2167-76 |
| 1087 | 2167-77 |
| 1088 | 2167-81 |
| 1089 | 2167-83 |
| 1090 | 2167-86 |
| 1091 | 2167-89 |
| 1092 | 2167-93 |
| 1093 | 2167-94 |
| 1094 | 2167-95 |
| 1095 | 2169-02 |
| 1096 | 2169-03 |
| 1097 | 2169-11 |
| 1098 | 2169-15 |
| 1099 | 2169-18 |
| 1100 | 2169-20 |
| 1101 | 2169-21 |
| 1102 | 2169-23 |
| 1103 | 2169-25 |
| 1104 | 2169-28 |
| 1105 | 2169-29 |
| 1106 | 2169-31 |
| 1107 | 2169-36 |
| 1108 | 2169-37 |
| 1109 | 2169-38 |
| 1110 | 2169-45 |
| 1111 | 2169-48 |
| 1112 | 2169-50 |
| 1113 | 2169-53 |
| 1114 | 2169-54 |

TABLE II-continued represents a variety of flea HMT nucleic acid molecules of the present invention.

| SEQ ID NO: | Name |
|---|---|
| 1115 | 2169-55 |
| 1116 | 2169-56 |
| 1117 | 2169-58 |
| 1118 | 2169-59 |
| 1119 | 2169-60 |
| 1120 | 2169-61 |
| 1121 | 2169-62 |
| 1122 | 2169-63 |
| 1123 | 2169-64 |
| 1124 | 2169-67 |
| 1125 | 2169-68 |
| 1126 | 2169-72 |
| 1127 | 2169-73 |
| 1128 | 2169-75 |
| 1129 | 2169-76 |
| 1130 | 2169-77 |
| 1131 | 2169-83 |
| 1132 | 2169-84 |
| 1133 | 2169-87 |
| 1134 | 2169-89 |
| 1135 | 2169-90 |
| 1136 | 2169-92 |
| 1137 | 2169-93 |
| 1138 | 2169-94 |
| 1139 | 2171-02 |
| 1140 | 2171-05 |
| 1141 | 2171-07 |
| 1142 | 2171-08 |
| 1143 | 2171-10 |
| 1144 | 2171-12 |
| 1145 | 2171-14 |
| 1146 | 2171-15 |
| 1147 | 2171-18 |
| 1148 | 2171-19 |
| 1149 | 2171-25 |
| 1150 | 2171-26 |
| 1151 | 2171-27 |
| 1152 | 2171-28 |
| 1153 | 2171-29 |
| 1154 | 2171-36 |
| 1155 | 2171-38 |
| 1156 | 2171-42 |
| 1157 | 2171-44 |
| 1158 | 2171-45 |
| 1159 | 2171-48 |
| 1160 | 2171-49 |
| 1161 | 2171-53 |
| 1162 | 2171-58 |
| 1163 | 2171-59 |
| 1164 | 2171-62 |
| 1165 | 2171-65 |
| 1166 | 2171-67 |
| 1167 | 2171-70 |
| 1168 | 2171-71 |
| 1169 | 2171-74 |
| 1170 | 2171-75 |
| 1171 | 2171-77 |
| 1172 | 2171-78 |
| 1173 | 2171-83 |
| 1174 | 2171-86 |
| 1175 | 2171-87 |
| 1176 | 2171-90 |
| 1177 | 2171-91 |
| 1178 | 2171-94 |
| 1179 | 2171-95 |
| 1180 | 2171-96 |
| 1181 | 2173-03 |
| 1182 | 2173-04 |
| 1183 | 2173-05 |
| 1184 | 2173-06 |
| 1185 | 2173-15 |
| 1186 | 2173-17 |
| 1187 | 2173-20 |
| 1188 | 2173-24 |
| 1189 | 2173-26 |
| 1190 | 2173-27 |
| 1191 | 2173-30 |
| 1192 | 2173-31 |
| 1193 | 2173-33 |
| 1194 | 2173-35 |
| 1195 | 2173-37 |
| 1196 | 2173-41 |
| 1197 | 2173-46 |
| 1198 | 2173-49 |
| 1199 | 2173-60 |
| 1200 | 2173-62 |
| 1201 | 2173-65 |
| 1202 | 2173-66 |
| 1203 | 2173-69 |
| 1204 | 2173-72 |
| 1205 | 2173-73 |
| 1206 | 2173-77 |
| 1207 | 2173-79 |
| 1208 | 2173-80 |
| 1209 | 2173-82 |
| 1210 | 2173-87 |
| 1211 | 2173-88 |
| 1212 | 2173-89 |
| 1213 | 2173-92 |
| 1214 | 2175-03 |
| 1215 | 2175-05 |
| 1216 | 2175-09 |
| 1217 | 2175-10 |
| 1218 | 2175-11 |
| 1219 | 2175-14 |
| 1220 | 2175-16 |
| 1221 | 2175-17 |
| 1222 | 2175-21 |
| 1223 | 2175-22 |
| 1224 | 2175-23 |
| 1225 | 2175-27 |
| 1226 | 2175-29 |
| 1227 | 2175-30 |
| 1228 | 2175-31 |
| 1229 | 2175-33 |
| 1230 | 2175-35 |
| 1231 | 2175-36 |
| 1232 | 2175-40 |
| 1233 | 2175-41 |
| 1234 | 2175-42 |
| 1235 | 2175-43 |
| 1236 | 2175-47 |
| 1237 | 2175-50 |
| 1238 | 2175-51 |
| 1239 | 2175-52 |
| 1240 | 2175-53 |
| 1241 | 2175-54 |
| 1242 | 2175-55 |
| 1243 | 2175-56 |
| 1244 | 2175-57 |
| 1245 | 2175-59 |
| 1246 | 2175-60 |
| 1247 | 2175-61 |
| 1248 | 2175-63 |
| 1249 | 2175-65 |
| 1250 | 2175-66 |
| 1251 | 2175-67 |
| 1252 | 2175-68 |
| 1253 | 2175-69 |
| 1254 | 2175-70 |
| 1255 | 2175-79 |
| 1256 | 2175-80 |
| 1257 | 2175-81 |
| 1258 | 2175-85 |
| 1259 | 2175-87 |
| 1260 | 2175-93 |
| 1261 | 2175-94 |
| 1262 | 2175-95 |
| 1263 | 2177-02 |
| 1264 | 2177-03 |

TABLE II-continued represents a variety of flea HMT nucleic acid molecules of the present invention.

| SEQ ID NO: | Name |
|---|---|
| 1265 | 2177-04 |
| 1266 | 2177-05 |
| 1267 | 2177-09 |
| 1268 | 2177-25 |
| 1269 | 2177-28 |
| 1270 | 2177-30 |
| 1271 | 2177-32 |
| 1272 | 2177-35 |
| 1273 | 2177-36 |
| 1274 | 2177-37 |
| 1275 | 2177-38 |
| 1276 | 2177-43 |
| 1277 | 2177-49 |
| 1278 | 2177-55 |
| 1279 | 2177-56 |
| 1280 | 2177-58 |
| 1281 | 2177-62 |
| 1282 | 2177-63 |
| 1283 | 2177-65 |
| 1284 | 2177-66 |
| 1285 | 2177-67 |
| 1286 | 2177-68 |
| 1287 | 2177-71 |
| 1288 | 2177-73 |
| 1289 | 2177-75 |
| 1290 | 2177-76 |
| 1291 | 2177-77 |
| 1292 | 2177-83 |
| 1293 | 2177-84 |
| 1294 | 2177-85 |
| 1295 | 2177-87 |
| 1296 | 2177-88 |
| 1297 | 2177-89 |
| 1298 | 2177-90 |
| 1299 | 2177-93 |
| 1300 | 2177-95 |
| 1301 | 2179-04 |
| 1302 | 2179-06 |
| 1303 | 2179-08 |
| 1304 | 2179-13 |
| 1305 | 2179-14 |
| 1306 | 2179-15 |
| 1307 | 2179-16 |
| 1308 | 2179-17 |
| 1309 | 2179-21 |
| 1310 | 2179-25 |
| 1311 | 2179-26 |
| 1312 | 2179-31 |
| 1313 | 2179-33 |
| 1314 | 2179-34 |
| 1315 | 2179-36 |
| 1316 | 2179-37 |
| 1317 | 2179-38 |
| 1318 | 2179-40 |
| 1319 | 2179-41 |
| 1320 | 2179-45 |
| 1321 | 2179-50 |
| 1322 | 2179-55 |
| 1323 | 2179-57 |
| 1324 | 2179-58 |
| 1325 | 2179-60 |
| 1326 | 2179-61 |
| 1327 | 2179-64 |
| 1328 | 2179-65 |
| 1329 | 2179-66 |
| 1330 | 2179-67 |
| 1331 | 2179-68 |
| 1332 | 2179-70 |
| 1333 | 2179-71 |
| 1334 | 2179-72 |
| 1335 | 2179-74 |
| 1336 | 2179-75 |
| 1337 | 2179-76 |
| 1338 | 2179-78 |
| 1339 | 2179-80 |
| 1340 | 2179-81 |
| 1341 | 2179-82 |
| 1342 | 2179-84 |
| 1343 | 2179-85 |
| 1344 | 2179-89 |
| 1345 | 2179-90 |
| 1346 | 2179-91 |
| 1347 | 2179-92 |
| 1348 | 2179-93 |
| 1349 | 2179-95 |
| 1350 | 2179-96 |
| 1351 | 2181-03 |
| 1352 | 2181-06 |
| 1353 | 2181-07 |
| 1354 | 2181-08 |
| 1355 | 2181-11 |
| 1356 | 2181-13 |
| 1357 | 2181-15 |
| 1358 | 2181-16 |
| 1359 | 2181-17 |
| 1360 | 2181-20 |
| 1361 | 2181-21 |
| 1362 | 2181-25 |
| 1363 | 2181-28 |
| 1364 | 2181-30 |
| 1365 | 2181-31 |
| 1366 | 2181-32 |
| 1367 | 2181-33 |
| 1368 | 2181-34 |
| 1369 | 2181-38 |
| 1370 | 2181-40 |
| 1371 | 2181-41 |
| 1372 | 2181-43 |
| 1373 | 2181-44 |
| 1374 | 2181-47 |
| 1375 | 2181-48 |
| 1376 | 2181-49 |
| 1377 | 2181-53 |
| 1378 | 2181-54 |
| 1379 | 2181-55 |
| 1380 | 2181-57 |
| 1381 | 2181-58 |
| 1382 | 2181-59 |
| 1383 | 2181-60 |
| 1384 | 2181-61 |
| 1385 | 2181-62 |
| 1386 | 2181-63 |
| 1387 | 2181-67 |
| 1388 | 2181-70 |
| 1389 | 2181-71 |
| 1390 | 2181-72 |
| 1391 | 2181-74 |
| 1392 | 2181-77 |
| 1393 | 2181-78 |
| 1394 | 2181-79 |
| 1395 | 2181-80 |
| 1396 | 2181-83 |
| 1397 | 2181-85 |
| 1398 | 2181-86 |
| 1399 | 2181-88 |
| 1400 | 2181-89 |
| 1401 | 2181-90 |
| 1402 | 2181-95 |
| 1403 | 2181-96 |
| 1404 | 2183-02 |
| 1405 | 2183-03 |
| 1406 | 2183-04 |
| 1407 | 2183-09 |
| 1408 | 2183-12 |
| 1409 | 2183-18 |
| 1410 | 2183-19 |
| 1411 | 2183-23 |
| 1412 | 2183-26 |
| 1413 | 2183-27 |
| 1414 | 2183-29 |

TABLE II-continued represents a variety of flea HMT nucleic acid molecules of the present invention.

| SEQ ID NO: | Name |
|---|---|
| 1415 | 2183-31 |
| 1416 | 2183-34 |
| 1417 | 2183-35 |
| 1418 | 2183-37 |
| 1419 | 2183-42 |
| 1420 | 2183-43 |
| 1421 | 2183-47 |
| 1422 | 2183-48 |
| 1423 | 2183-54 |
| 1424 | 2183-56 |
| 1425 | 2183-57 |
| 1426 | 2183-60 |
| 1427 | 2183-63 |
| 1428 | 2183-64 |
| 1429 | 2183-66 |
| 1430 | 2183-67 |
| 1431 | 2183-72 |
| 1432 | 2183-73 |
| 1433 | 2183-74 |
| 1434 | 2183-75 |
| 1435 | 2183-76 |
| 1436 | 2183-78 |
| 1437 | 2183-79 |
| 1438 | 2183-80 |
| 1439 | 2183-82 |
| 1440 | 2183-83 |
| 1441 | 2183-84 |
| 1442 | 2183-87 |
| 1443 | 2183-89 |
| 1444 | 2183-91 |
| 1445 | 2183-92 |
| 1446 | 2183-94 |
| 1447 | 2185-02 |
| 1448 | 2185-03 |
| 1449 | 2185-06 |
| 1450 | 2185-07 |
| 1451 | 2185-08 |
| 1452 | 2185-11 |
| 1453 | 2185-13 |
| 1454 | 2185-14 |
| 1455 | 2185-17 |
| 1456 | 2185-18 |
| 1457 | 2185-25 |
| 1458 | 2185-26 |
| 1459 | 2185-30 |
| 1460 | 2185-31 |
| 1461 | 2185-32 |
| 1462 | 2185-35 |
| 1463 | 2185-37 |
| 1464 | 2185-39 |
| 1465 | 2185-40 |
| 1466 | 2185-42 |
| 1467 | 2185-45 |
| 1468 | 2185-46 |
| 1469 | 2185-47 |
| 1470 | 2185-50 |
| 1471 | 2185-58 |
| 1472 | 2185-63 |
| 1473 | 2185-64 |
| 1474 | 2185-65 |
| 1475 | 2185-67 |
| 1476 | 2185-68 |
| 1477 | 2185-72 |
| 1478 | 2185-73 |
| 1479 | 2185-74 |
| 1480 | 2185-76 |
| 1481 | 2185-77 |
| 1482 | 2185-79 |
| 1483 | 2185-83 |
| 1484 | 2185-85 |
| 1485 | 2185-86 |
| 1486 | 2185-87 |
| 1487 | 2185-89 |
| 1488 | 2185-90 |
| 1489 | 2185-92 |
| 1490 | 2185-93 |
| 1491 | 2185-94 |
| 1492 | 2185-96 |
| 1493 | 2187-02 |
| 1494 | 2187-06 |
| 1495 | 2187-08 |
| 1496 | 2187-11 |
| 1497 | 2187-12 |
| 1498 | 2187-15 |
| 1499 | 2187-16 |
| 1500 | 2187-19 |
| 1501 | 2187-22 |
| 1502 | 2187-26 |
| 1503 | 2187-27 |
| 1504 | 2187-28 |
| 1505 | 2187-29 |
| 1506 | 2187-30 |
| 1507 | 2187-34 |
| 1508 | 2187-35 |
| 1509 | 2187-37 |
| 1510 | 2187-38 |
| 1511 | 2187-39 |
| 1512 | 2187-40 |
| 1513 | 2187-41 |
| 1514 | 2187-42 |
| 1515 | 2187-44 |
| 1516 | 2187-46 |
| 1517 | 2187-48 |
| 1518 | 2187-50 |
| 1519 | 2187-51 |
| 1520 | 2187-52 |
| 1521 | 2187-54 |
| 1522 | 2187-55 |
| 1523 | 2187-56 |
| 1524 | 2187-57 |
| 1525 | 2187-58 |
| 1526 | 2187-60 |
| 1527 | 2187-61 |
| 1528 | 2187-62 |
| 1529 | 2187-63 |
| 1530 | 2187-70 |
| 1531 | 2187-71 |
| 1532 | 2187-72 |
| 1533 | 2187-73 |
| 1534 | 2187-80 |
| 1535 | 2187-84 |
| 1536 | 2187-85 |
| 1537 | 2187-86 |
| 1538 | 2187-87 |
| 1539 | 2187-88 |
| 1540 | 2187-91 |
| 1541 | 2187-94 |
| 1542 | 2187-96 |
| 1543 | 2188-04 |
| 1544 | 2188-08 |
| 1545 | 2188-09 |
| 1546 | 2188-11 |
| 1547 | 2188-18 |
| 1548 | 2188-20 |
| 1549 | 2188-21 |
| 1550 | 2188-23 |
| 1551 | 2188-25 |
| 1552 | 2188-31 |
| 1553 | 2188-37 |
| 1554 | 2188-38 |
| 1555 | 2188-42 |
| 1556 | 2188-43 |
| 1557 | 2188-44 |
| 1558 | 2188-47 |
| 1559 | 2188-50 |
| 1560 | 2188-53 |
| 1561 | 2188-55 |
| 1562 | 2188-57 |
| 1563 | 2188-59 |
| 1564 | 2188-61 |

TABLE II-continued represents a variety of flea HMT nucleic acid molecules of the present invention.

| SEQ ID NO: | Name |
|---|---|
| 1565 | 2188-64 |
| 1566 | 2188-69 |
| 1567 | 2188-70 |
| 1568 | 2188-71 |
| 1569 | 2188-73 |
| 1570 | 2188-76 |
| 1571 | 2188-79 |
| 1572 | 2188-84 |
| 1573 | 2188-85 |
| 1574 | 2188-87 |
| 1575 | 2188-88 |
| 1576 | 2188-89 |
| 1577 | 2188-94 |
| 1578 | 2188-95 |
| 1579 | 2188-96 |
| 1580 | 2189-02 |
| 1581 | 2189-03 |
| 1582 | 2189-04 |
| 1583 | 2189-05 |
| 1584 | 2189-06 |
| 1585 | 2189-07 |
| 1586 | 2189-09 |
| 1587 | 2189-10 |
| 1588 | 2189-11 |
| 1589 | 2189-12 |
| 1590 | 2189-14 |
| 1591 | 2189-15 |
| 1592 | 2189-16 |
| 1593 | 2189-18 |
| 1594 | 2189-19 |
| 1595 | 2189-20 |
| 1596 | 2189-22 |
| 1597 | 2189-23 |
| 1598 | 2189-24 |
| 1599 | 2189-25 |
| 1600 | 2189-26 |
| 1601 | 2189-27 |
| 1602 | 2189-28 |
| 1603 | 2189-29 |
| 1604 | 2189-30 |
| 1605 | 2189-32 |
| 1606 | 2189-33 |
| 1607 | 2189-34 |
| 1608 | 2189-35 |
| 1609 | 2189-36 |
| 1610 | 2189-37 |
| 1611 | 2189-38 |
| 1612 | 2189-40 |
| 1613 | 2189-41 |
| 1614 | 2189-43 |
| 1615 | 2189-44 |
| 1616 | 2189-46 |
| 1617 | 2189-47 |
| 1618 | 2189-49 |
| 1619 | 2189-50 |
| 1620 | 2189-52 |
| 1621 | 2189-54 |
| 1622 | 2189-58 |
| 1623 | 2189-59 |
| 1624 | 2189-60 |
| 1625 | 2189-61 |
| 1626 | 2189-62 |
| 1627 | 2189-64 |
| 1628 | 2189-68 |
| 1629 | 2189-72 |
| 1630 | 2189-77 |
| 1631 | 2189-78 |
| 1632 | 2189-79 |
| 1633 | 2189-80 |
| 1634 | 2189-82 |
| 1635 | 2189-88 |
| 1636 | 2189-93 |
| 1637 | 2189-95 |
| 1638 | 2191-05 |
| 1639 | 2191-06 |
| 1640 | 2191-10 |
| 1641 | 2191-11 |
| 1642 | 2191-13 |
| 1643 | 2191-14 |
| 1644 | 2191-15 |
| 1645 | 2191-16 |
| 1646 | 2191-19 |
| 1647 | 2191-21 |
| 1648 | 2191-26 |
| 1649 | 2191-30 |
| 1650 | 2191-31 |
| 1651 | 2191-32 |
| 1652 | 2191-36 |
| 1653 | 2191-37 |
| 1654 | 2191-39 |
| 1655 | 2191-40 |
| 1656 | 2191-42 |
| 1657 | 2191-43 |
| 1658 | 2191-45 |
| 1659 | 2191-48 |
| 1660 | 2191-49 |
| 1661 | 2191-50 |
| 1662 | 2191-54 |
| 1663 | 2191-55 |
| 1664 | 2191-56 |
| 1665 | 2191-61 |
| 1666 | 2191-62 |
| 1667 | 2191-64 |
| 1668 | 2191-65 |
| 1669 | 2191-70 |
| 1670 | 2191-71 |
| 1671 | 2191-74 |
| 1672 | 2191-75 |
| 1673 | 2191-80 |
| 1674 | 2191-84 |
| 1675 | 2191-86 |
| 1676 | 2191-89 |
| 1677 | 2191-91 |
| 1678 | 2191-93 |
| 1679 | 2191-95 |
| 1680 | 2192-04 |
| 1681 | 2192-05 |
| 1682 | 2192-10 |
| 1683 | 2192-11 |
| 1684 | 2192-13 |
| 1685 | 2192-16 |
| 1686 | 2192-18 |
| 1687 | 2192-19 |
| 1688 | 2192-20 |
| 1689 | 2192-21 |
| 1690 | 2192-24 |
| 1691 | 2192-27 |
| 1692 | 2192-32 |
| 1693 | 2192-33 |
| 1694 | 2192-34 |
| 1695 | 2192-39 |
| 1696 | 2192-40 |
| 1697 | 2192-41 |
| 1698 | 2192-45 |
| 1699 | 2192-48 |
| 1700 | 2192-49 |
| 1701 | 2192-51 |
| 1702 | 2192-52 |
| 1703 | 2192-54 |
| 1704 | 2192-55 |
| 1705 | 2192-56 |
| 1706 | 2192-57 |
| 1707 | 2192-58 |
| 1708 | 2192-61 |
| 1709 | 2192-62 |
| 1710 | 2192-64 |
| 1711 | 2192-65 |
| 1712 | 2192-67 |
| 1713 | 2192-73 |
| 1714 | 2192-75 |

TABLE II-continued represents a variety of flea HMT nucleic acid molecules of the present invention.

| SEQ ID NO: | Name |
|---|---|
| 1715 | 2192-76 |
| 1716 | 2192-80 |
| 1717 | 2192-81 |
| 1718 | 2192-83 |
| 1719 | 2192-84 |
| 1720 | 2192-87 |
| 1721 | 2192-89 |
| 1722 | 2192-90 |
| 1723 | 2192-92 |
| 1724 | 2192-93 |
| 1725 | 2192-95 |
| 1726 | 2193-02 |
| 1727 | 2193-05 |
| 1728 | 2193-06 |
| 1729 | 2193-07 |
| 1730 | 2193-08 |
| 1731 | 2193-09 |
| 1732 | 2193-11 |
| 1733 | 2193-12 |
| 1734 | 2193-13 |
| 1735 | 2193-14 |
| 1736 | 2193-15 |
| 1737 | 2193-16 |
| 1738 | 2193-19 |
| 1739 | 2193-20 |
| 1740 | 2193-21 |
| 1741 | 2193-22 |
| 1742 | 2193-23 |
| 1743 | 2193-26 |
| 1744 | 2193-28 |
| 1745 | 2193-30 |
| 1746 | 2193-32 |
| 1747 | 2193-33 |
| 1748 | 2193-34 |
| 1749 | 2193-35 |
| 1750 | 2193-38 |
| 1751 | 2193-40 |
| 1752 | 2193-41 |
| 1753 | 2193-42 |
| 1754 | 2193-44 |
| 1755 | 2193-46 |
| 1756 | 2193-48 |
| 1757 | 2193-55 |
| 1758 | 2193-57 |
| 1759 | 2193-58 |
| 1760 | 2193-59 |
| 1761 | 2193-62 |
| 1762 | 2193-63 |
| 1763 | 2193-64 |
| 1764 | 2193-66 |
| 1765 | 2193-68 |
| 1766 | 2193-69 |
| 1767 | 2193-70 |
| 1768 | 2193-72 |
| 1769 | 2193-73 |
| 1770 | 2193-74 |
| 1771 | 2193-76 |
| 1772 | 2193-78 |
| 1773 | 2193-81 |
| 1774 | 2193-82 |
| 1775 | 2193-83 |
| 1776 | 2193-84 |
| 1777 | 2193-85 |
| 1778 | 2193-86 |
| 1779 | 2193-87 |
| 1780 | 2193-88 |
| 1781 | 2193-91 |
| 1782 | 2194-02 |
| 1783 | 2194-03 |
| 1784 | 2194-04 |
| 1785 | 2194-05 |
| 1786 | 2194-06 |
| 1787 | 2194-08 |
| 1788 | 2194-10 |
| 1789 | 2194-11 |
| 1790 | 2194-12 |
| 1791 | 2194-15 |
| 1792 | 2194-19 |
| 1793 | 2194-21 |
| 1794 | 2194-25 |
| 1795 | 2194-26 |
| 1796 | 2194-31 |
| 1797 | 2194-33 |
| 1798 | 2194-34 |
| 1799 | 2194-36 |
| 1800 | 2194-44 |
| 1801 | 2194-45 |
| 1802 | 2194-46 |
| 1803 | 2194-47 |
| 1804 | 2194-48 |
| 1805 | 2194-49 |
| 1806 | 2194-53 |
| 1807 | 2194-54 |
| 1808 | 2194-56 |
| 1809 | 2194-57 |
| 1810 | 2194-58 |
| 1811 | 2194-59 |
| 1812 | 2194-60 |
| 1813 | 2194-61 |
| 1814 | 2194-64 |
| 1815 | 2194-65 |
| 1816 | 2194-66 |
| 1817 | 2194-67 |
| 1818 | 2194-68 |
| 1819 | 2194-70 |
| 1820 | 2194-71 |
| 1821 | 2194-73 |
| 1822 | 2194-74 |
| 1823 | 2194-76 |
| 1824 | 2194-77 |
| 1825 | 2194-79 |
| 1826 | 2194-80 |
| 1827 | 2194-82 |
| 1828 | 2194-87 |
| 1829 | 2194-89 |
| 1830 | 2194-90 |
| 1831 | 2194-91 |
| 1832 | 2194-94 |
| 1833 | 2195-03 |
| 1834 | 2195-04 |
| 1835 | 2195-13 |
| 1836 | 2195-18 |
| 1837 | 2195-19 |
| 1838 | 2195-20 |
| 1839 | 2195-21 |
| 1840 | 2195-23 |
| 1841 | 2195-25 |
| 1842 | 2195-27 |
| 1843 | 2195-29 |
| 1844 | 2195-32 |
| 1845 | 2195-33 |
| 1846 | 2195-35 |
| 1847 | 2195-36 |
| 1848 | 2195-37 |
| 1849 | 2195-38 |
| 1850 | 2195-39 |
| 1851 | 2195-41 |
| 1852 | 2195-42 |
| 1853 | 2195-43 |
| 1854 | 2195-44 |
| 1855 | 2195-46 |
| 1856 | 2195-48 |
| 1857 | 2195-50 |
| 1858 | 2195-52 |
| 1859 | 2195-56 |
| 1860 | 2195-58 |
| 1861 | 2195-59 |
| 1862 | 2195-62 |
| 1863 | 2195-63 |
| 1864 | 2195-64 |

TABLE II-continued represents a variety of flea HMT nucleic acid molecules of the present invention.

| SEQ ID NO: | Name |
|---|---|
| 1865 | 2195-65 |
| 1866 | 2195-68 |
| 1867 | 2195-70 |
| 1868 | 2195-71 |
| 1869 | 2195-74 |
| 1870 | 2195-75 |
| 1871 | 2195-77 |
| 1872 | 2195-78 |
| 1873 | 2195-79 |
| 1874 | 2195-81 |
| 1875 | 2195-82 |
| 1876 | 2195-87 |
| 1877 | 2195-88 |
| 1878 | 2195-89 |
| 1879 | 2195-90 |
| 1880 | 2195-91 |
| 1881 | 2195-93 |
| 1882 | 2195-96 |
| 1883 | 2196-02 |
| 1884 | 2196-05 |
| 1885 | 2196-06 |
| 1886 | 2196-08 |
| 1887 | 2196-09 |
| 1888 | 2196-11 |
| 1889 | 2196-15 |
| 1890 | 2196-16 |
| 1891 | 2196-17 |
| 1892 | 2196-23 |
| 1893 | 2196-25 |
| 1894 | 2196-28 |
| 1895 | 2196-32 |
| 1896 | 2196-33 |
| 1897 | 2196-34 |
| 1898 | 2196-35 |
| 1899 | 2196-36 |
| 1900 | 2196-38 |
| 1901 | 2196-39 |
| 1902 | 2196-40 |
| 1903 | 2196-41 |
| 1904 | 2196-45 |
| 1905 | 2196-49 |
| 1906 | 2196-51 |
| 1907 | 2196-55 |
| 1908 | 2196-56 |
| 1909 | 2196-57 |
| 1910 | 2196-58 |
| 1911 | 2196-66 |
| 1912 | 2196-67 |
| 1913 | 2196-68 |
| 1914 | 2196-73 |
| 1915 | 2196-77 |
| 1916 | 2196-80 |
| 1917 | 2196-87 |
| 1918 | 2196-89 |
| 1919 | 2196-91 |
| 1920 | 2196-92 |
| 1921 | 2196-93 |
| 1922 | 2196-94 |
| 1923 | 2196-96 |
| 1924 | 2197-02 |
| 1925 | 2197-04 |
| 1926 | 2197-05 |
| 1927 | 2197-06 |
| 1928 | 2197-07 |
| 1929 | 2197-09 |
| 1930 | 2197-10 |
| 1931 | 2197-11 |
| 1932 | 2197-12 |
| 1933 | 2197-13 |
| 1934 | 2197-15 |
| 1935 | 2197-16 |
| 1936 | 2197-19 |
| 1937 | 2197-20 |
| 1938 | 2197-27 |
| 1939 | 2197-29 |
| 1940 | 2197-30 |
| 1941 | 2197-31 |
| 1942 | 2197-35 |
| 1943 | 2197-36 |
| 1944 | 2197-37 |
| 1945 | 2197-38 |
| 1946 | 2197-39 |
| 1947 | 2197-40 |
| 1948 | 2197-41 |
| 1949 | 2197-43 |
| 1950 | 2197-44 |
| 1951 | 2197-45 |
| 1952 | 2197-48 |
| 1953 | 2197-49 |
| 1954 | 2197-52 |
| 1955 | 2197-55 |
| 1956 | 2197-56 |
| 1957 | 2197-57 |
| 1958 | 2197-61 |
| 1959 | 2197-62 |
| 1960 | 2197-63 |
| 1961 | 2197-65 |
| 1962 | 2197-66 |
| 1963 | 2197-67 |
| 1964 | 2197-69 |
| 1965 | 2197-71 |
| 1966 | 2197-74 |
| 1967 | 2197-75 |
| 1968 | 2197-76 |
| 1969 | 2197-77 |
| 1970 | 2197-79 |
| 1971 | 2197-82 |
| 1972 | 2197-83 |
| 1973 | 2197-84 |
| 1974 | 2197-85 |
| 1975 | 2197-87 |
| 1976 | 2197-88 |
| 1977 | 2197-89 |
| 1978 | 2197-94 |
| 1979 | 2197-96 |
| 1980 | 2202-18 |
| 1981 | 2202-19 |
| 1982 | 2202-22 |
| 1983 | 2202-25 |
| 1984 | 2202-28 |
| 1985 | 2202-30 |
| 1986 | 2202-31 |
| 1987 | 2202-32 |
| 1988 | 2202-38 |
| 1989 | 2202-44 |
| 1990 | 2202-46 |
| 1991 | 2202-55 |
| 1992 | 2202-64 |
| 1993 | 2202-66 |
| 1994 | 2202-67 |
| 1995 | 2202-68 |
| 1996 | 2202-71 |
| 1997 | 2202-72 |
| 1998 | 2202-73 |
| 1999 | 2202-04 |
| 2000 | 2202-87 |
| 2001 | 2202-93 |
| 2002 | 2202-94 |
| 2003 | 2203-12 |
| 2004 | 2203-20 |
| 2005 | 2203-24 |
| 2006 | 2202-26 |
| 2007 | 2202-30 |
| 2008 | 2202-52 |
| 2009 | 2202-74 |
| 2010 | 2202-78 |
| 2011 | 2202-87 |
| 2012 | 2202-93 |
| 2013 | 2202-94 |
| 2014 | 2204-02 |

TABLE II-continued represents a variety of flea HMT nucleic acid molecules of the present invention.

| SEQ ID NO: | Name |
| --- | --- |
| 2015 | 2204-08 |
| 2016 | 2204-12 |
| 2017 | 2204-14 |
| 2018 | 2204-42 |
| 2019 | 2204-43 |
| 2020 | 2204-49 |
| 2021 | 2204-51 |
| 2022 | 2204-53 |
| 2023 | 2204-54 |
| 2024 | 2204-59 |
| 2025 | 2204-60 |
| 2026 | 2204-61 |
| 2027 | 2204-70 |
| 2028 | 2204-71 |
| 2029 | 2204-73 |
| 2030 | 2204-74 |
| 2031 | 2204-78 |
| 2032 | 2204-83 |
| 2033 | 2204-90 |
| 2034 | 2205-05 |
| 2035 | 2205-11 |
| 2036 | 2205-13 |
| 2037 | 2205-21 |
| 2038 | 2205-22 |
| 2039 | 2205-39 |
| 2040 | 2205-42 |
| 2041 | 2205-44 |
| 2042 | 2205-81 |
| 2043 | 2205-88 |
| 2044 | 2205-94 |
| 2045 | 2229-15 |
| 2046 | 2229-21 |
| 2047 | 2229-23 |
| 2048 | 2229-26 |
| 2049 | 2229-28 |
| 2050 | 2229-30 |
| 2051 | 2229-32 |
| 2052 | 2229-43 |
| 2053 | 2229-52 |
| 2054 | 2229-66 |
| 2055 | 2229-85 |
| 2056 | 2230-17 |
| 2057 | 2230-18 |
| 2058 | 2230-25 |
| 2059 | 2230-29 |
| 2060 | 2230-32 |
| 2061 | 2230-34 |
| 2062 | 2230-46 |
| 2063 | 2230-47 |
| 2064 | 2230-58 |
| 2065 | 2230-65 |
| 2066 | 2230-73 |
| 2067 | 2230-74 |
| 2068 | 2230-95 |
| 2069 | 2231-04 |
| 2070 | 2231-13 |
| 2071 | 2231-16 |
| 2072 | 2231-21 |
| 2073 | 2231-25 |
| 2074 | 2231-28 |
| 2075 | 2231-48 |
| 2076 | 2231-54 |
| 2077 | 2231-58 |
| 2078 | 2231-61 |
| 2079 | 2231-69 |
| 2080 | 2231-93 |
| 2081 | 2232-17 |
| 2082 | 2232-20 |
| 2083 | 2232-26 |
| 2084 | 2232-29 |
| 2085 | 2232-36 |
| 2086 | 2232-37 |
| 2087 | 2232-45 |
| 2088 | 2232-47 |
| 2089 | 2232-48 |
| 2090 | 2232-53 |
| 2091 | 2232-62 |
| 2092 | 2232-75 |
| 2093 | 2232-76 |
| 2094 | 2232-88 |
| 2095 | 2232-89 |
| 2096 | 2232-90 |
| 2097 | 2232-92 |
| 2098 | 2232-93 |
| 2099 | 2232-94 |
| 2100 | 2233-07 |
| 2101 | 2233-15 |
| 2102 | 2233-17 |
| 2103 | 2233-23 |
| 2104 | 2233-26 |
| 2105 | 2233-30 |
| 2106 | 2233-31 |
| 2107 | 2233-34 |
| 2108 | 2233-36 |
| 2109 | 2233-37 |
| 2110 | 2233-43 |
| 2111 | 2233-44 |
| 2112 | 2233-49 |
| 2113 | 2233-50 |
| 2114 | 2233-52 |
| 2115 | 2233-62 |
| 2116 | 2233-73 |
| 2117 | 2233-76 |
| 2118 | 2233-78 |
| 2119 | 2233-79 |
| 2120 | 2233-82 |
| 2121 | 2233-88 |
| 2122 | 2234-04 |
| 2123 | 2234-13 |
| 2124 | 2234-16 |
| 2125 | 2234-22 |
| 2126 | 2234-24 |
| 2127 | 2234-38 |
| 2128 | 2234-41 |
| 2129 | 2234-45 |
| 2130 | 2234-48 |
| 2131 | 2234-49 |
| 2132 | 2234-59 |
| 2133 | 2234-69 |
| 2134 | 2234-83 |
| 2135 | 2234-84 |
| 2136 | 2234-87 |
| 2137 | 2234-92 |
| 2138 | 2234-95 |
| 2139 | 2240-15 |
| 2140 | 2240-16 |
| 2141 | 2240-25 |
| 2142 | 2240-27 |
| 2143 | 2240-30 |
| 2144 | 2240-32 |
| 2145 | 2240-41 |
| 2146 | 2240-45 |
| 2147 | 2240-50 |
| 2148 | 2240-56 |
| 2149 | 2240-65 |
| 2150 | 2240-68 |
| 2151 | 2240-73 |
| 2152 | 2240-78 |
| 2153 | 2240-79 |
| 2154 | 2240-81 |
| 2155 | 2240-84 |
| 2156 | 2240-96 |
| 2157 | 2241-06 |
| 2158 | 2241-20 |
| 2159 | 2241-32 |
| 2160 | 2241-33 |
| 2161 | 2241-34 |
| 2162 | 2241-43 |
| 2163 | 2241-46 |
| 2164 | 2241-48 |

TABLE II-continued represents a variety of flea HMT nucleic acid molecules of the present invention.

| SEQ ID NO: | Name |
|---|---|
| 2165 | 2241-50 |
| 2166 | 2241-53 |
| 2167 | 2241-67 |
| 2168 | 2241-71 |
| 2169 | 2241-75 |
| 2170 | 2241-77 |
| 2171 | 2241-79 |
| 2172 | 2241-88 |
| 2173 | 2241-96 |
| 2174 | 2243-05 |
| 2175 | 2243-07 |
| 2176 | 2243-16 |
| 2177 | 2243-23 |
| 2178 | 2243-26 |
| 2179 | 2243-34 |
| 2180 | 2243-40 |
| 2181 | 2243-42 |
| 2182 | 2243-58 |
| 2183 | 2243-60 |
| 2184 | 2243-65 |
| 2185 | 2243-70 |
| 2186 | 2243-80 |
| 2187 | 2243-84 |
| 2188 | 2244-04 |
| 2189 | 2244-07 |
| 2190 | 2244-09 |
| 2191 | 2244-10 |
| 2192 | 2244-17 |
| 2193 | 2244-18 |
| 2194 | 2244-20 |
| 2195 | 2244-22 |
| 2196 | 2244-24 |
| 2197 | 2244-28 |
| 2198 | 2244-34 |
| 2299 | 2244-37 |
| 2200 | 2244-39 |
| 2201 | 2244-41 |
| 2202 | 2244-46 |
| 2203 | 2244-50 |
| 2204 | 2244-51 |
| 2205 | 2244-56 |
| 2206 | 2244-60 |
| 2207 | 2244-67 |
| 2208 | 2244-70 |
| 2209 | 2244-72 |
| 2210 | 2244-73 |
| 2211 | 2244-79 |
| 2212 | 2244-81 |
| 2213 | 2244-85 |
| 2214 | 2244-88 |
| 2215 | 2244-89 |
| 2216 | 2244-90 |
| 2217 | 2244-92 |
| 2218 | 2244-93 |
| 2219 | 2244-94 |
| 2220 | 2244-95 |
| 2221 | 2244-96 |
| 2222 | 2253-03 |
| 2223 | 2253-09 |
| 2224 | 2253-10 |
| 2225 | 2253-15 |
| 2226 | 2253-17 |
| 2227 | 2253-25 |
| 2228 | 2253-26 |
| 2229 | 2253-29 |
| 2230 | 2253-31 |
| 2231 | 2253-34 |
| 2232 | 2253-45 |
| 2233 | 2253-47 |
| 2234 | 2253-48 |
| 2235 | 2253-49 |
| 2236 | 2253-51 |
| 2237 | 2253-57 |
| 2238 | 2253-64 |
| 2239 | 2253-69 |
| 2240 | 2253-71 |
| 2241 | 2253-72 |
| 2242 | 2253-74 |
| 2243 | 2253-75 |
| 2244 | 2253-76 |
| 2245 | 2253-77 |
| 2246 | 2253-85 |
| 2247 | 2253-91 |
| 2248 | 2253-93 |
| 2249 | 2254-02 |
| 2250 | 2254-03 |
| 2251 | 2254-05 |
| 2252 | 2254-09 |
| 2253 | 2254-11 |
| 2254 | 2254-19 |
| 2255 | 2254-20 |
| 2256 | 2254-22 |
| 2257 | 2254-34 |
| 2258 | 2254-42 |
| 2259 | 2254-44 |
| 2260 | 2254-46 |
| 2261 | 2254-49 |
| 2262 | 2254-50 |
| 2263 | 2254-52 |
| 2264 | 2254-59 |
| 2265 | 2254-61 |
| 2266 | 2254-64 |
| 2267 | 2254-73 |
| 2268 | 2254-75 |
| 2269 | 2254-77 |
| 2270 | 2254-78 |
| 2271 | 2254-81 |
| 2272 | 2254-82 |
| 2273 | 2254-89 |
| 2274 | 2254-90 |
| 2275 | 2254-94 |
| 2276 | 2255-06 |
| 2277 | 2255-09 |
| 2278 | 2255-11 |
| 2279 | 2255-26 |
| 2280 | 2255-27 |
| 2281 | 2255-29 |
| 2282 | 2255-38 |
| 2283 | 2255-44 |
| 2284 | 2255-48 |
| 2285 | 2255-53 |
| 2286 | 2255-65 |
| 2287 | 2255-74 |
| 2288 | 2255-78 |
| 2289 | 2255-81 |
| 2290 | 2255-83 |
| 2291 | 2255-84 |
| 2292 | 2255-87 |
| 2293 | 2255-92 |
| 2294 | 2255-93 |
| 2295 | 2256-02 |
| 2296 | 2256-09 |
| 2297 | 2256-10 |
| 2298 | 2256-25 |
| 2299 | 2256-37 |
| 2300 | 2256-51 |
| 2301 | 2256-53 |
| 2302 | 2256-56 |
| 2303 | 2256-60 |
| 2304 | 2256-63 |
| 2305 | 2256-66 |
| 2306 | 2256-68 |
| 2307 | 2256-71 |
| 2308 | 2256-74 |
| 2309 | 2256-81 |
| 2310 | 2256-83 |
| 2311 | 2256-84 |
| 2312 | 2256-88 |
| 2313 | 2256-95 |

In one embodiment, a gene or other nucleic acid molecule of the present invention can be an allelic variant that includes a similar but not identical sequence to a *C. felis* nucleic acid sequence of Table I and/or Table II or a complement thereof. For example, an allelic variant of a *C. felis* gene including SEQ ID NO:1 is a gene that occurs at essentially the same locus (or loci) in the genome as the gene including SEQ ID NO:1, but which, due to natural variations caused by, for example, mutation or recombination, has a similar but not identical sequence. Because natural selection typically selects against alterations that affect function, allelic variants (i.e. alleles corresponding to, or of, cited nucleic acid sequences) usually encode proteins having similar activity to that of the protein encoded by the gene to which they are being compared. Allelic variants of genes or nucleic acid molecules can also comprise alterations in the 5' or 3' untranslated regions of the gene (e.g., in regulatory control regions), or can involve alternative splicing of a nascent transcript, thereby bringing alternative exons into juxtaposition. Allelic variants are well known to those skilled in the art and would be expected to occur naturally within a given flea such as *C. felis*, since the genome is diploid, and sexual reproduction will result in the reassortment of alleles.

In one embodiment of the present invention, isolated HMT and HNC proteins are encoded by nucleic acid molecules that hybridize under stringent hybridization conditions to genes or other nucleic acid molecules encoding flea HMT and HNC proteins, respectively. The minimal size of HMT and HNC proteins of the present invention is a size sufficient to be encoded by a nucleic acid molecule capable of forming a stable hybrid (i.e., hybridizing under stringent hybridization conditions) with the complementary sequence of a nucleic acid molecule encoding the corresponding natural protein. The size of a nucleic acid molecule encoding such a protein is dependent on the nucleic acid composition and the percent homology between the flea HMT or HNC nucleic acid molecule and the complementary nucleic acid sequence. It can easily be understood that the extent of homology required to form a stable hybrid under stringent conditions can vary depending on whether the homologous sequences are interspersed throughout a given nucleic acid molecule or are clustered (i.e., localized) in distinct regions on a given nucleic acid molecule.

The minimal size of a nucleic acid molecule capable of forming a stable hybrid with a gene encoding a flea HMT or HNC protein is typically at least about 12 to about 15 nucleotides in length if the nucleic acid molecule is GC-rich and at least about 15 to about 17 bases in length if it is AT-rich. The minimal size of a nucleic acid molecule used to encode an HMT or HNC protein homologue of the present invention is from to about 12 to about 18 nucleotides in length. Thus, the minimal size of HMT or HNC protein homologues of the present invention is from about 4 to about 6 amino acids in length. There is no limit, other than a practical limit, on the maximal size of a nucleic acid molecule encoding a flea HMT or HNC protein of the present invention because a nucleic acid molecule of the present invention can include a portion of a gene, an entire gene, or multiple genes. The preferred size of a protein encoded by a nucleic acid molecule of the present invention depends on whether a full-length, fusion, multivalent, or functional portion of such a protein is desired.

Stringent hybridization conditions are determined based on defined physical properties of the gene to which the nucleic acid molecule is being hybridized, and can be defined mathematically Stringent hybridization conditions are those experimental parameters that allow an individual skilled in the art to identify significant similarities between heterologous nucleic acid molecules. These conditions are well known to those skilled in the art. See, for example, Sambrook, et al., 1989, *Molecular Cloning: A Laboratory Manual*, Cold Spring Harbor Labs Press, and Meinkoth, et al., 1984, *Anal. Biochem.* 138, 267-284, each of which is incorporated by reference herein in its entirety. As explained in detail in the cited references, the determination of hybridization conditions involves the manipulation of a set of variables including the ionic strength (M, in moles/liter), the hybridization temperature (° C.), the concentration of nucleic acid helix destabilizing agents (such as formamide), the average length of the shortest hybrid duplex (n), and the percent G+C composition of the fragment to which an unknown nucleic acid molecule is being hybridized. For nucleic acid molecules of at least about 150 nucleotides, these variables are inserted into a standard mathematical formula to calculate the melting temperature, or $T_m$, of a given nucleic acid molecule. As defined in the formula below, $T_m$ is the temperature at which two complementary nucleic acid molecule strands will disassociate, assuming 100% complementarily between the two strands:

$$T_m = 81.5° C. + 16.6 \log M + 0.41(\% G+C) - 500/n - 0.61(\% \text{ formamide}).$$

For nucleic acid molecules smaller than about 50 nucleotides, hybrid stability is defined by the dissociation temperature ($T_d$), which is defined as the temperature at which 50% of the duplexes dissociate. For these smaller molecules, the stability at a standard ionic strength is defined by the following equation:

$$T_d = 4(G+C) + 2(A+T).$$

A temperature of 5° C. below $T_d$ is used to detect hybridization between perfectly matched molecules.

Also well known to those skilled in the art is how base pair mismatch, i.e. differences between two nucleic acid molecules being compared, including non-complementarity of bases at a given location, and gaps due to insertion or deletion of one or more bases at a given location on either of the nucleic acid molecules being compared, will affect $T_m$ or $T_d$ for nucleic acid molecules of different sizes. For example, $T_m$ decreases about 1° C. for each 1% of mismatched base pairs for hybrids greater than about 150 bp, and $T_d$ decreases about 5° C. for each mismatched base pair for hybrids below about 50 bp. Conditions for hybrids between about 50 and about 150 base pairs can be determined empirically and without undue experimentation using standard laboratory procedures well known to those skilled in the art. These simple procedures allow one skilled in the art to set the hybridization conditions (by altering, for example, the salt concentration, the helix destabilizing compound concentration or the temperature) so that only nucleic acid hybrids with greater than a specified % base pair mismatch will hybridize. Stringent hybridization conditions are commonly understood by those skilled in the art to be those experimental conditions that will allow less than or equal to about 30% base pair mismatch (i.e., at least about 70% identity). Because one skilled in the art can easily determine whether a given nucleic acid molecule to be tested is less than or greater than about 50 nucleotides, and can therefore choose the appropriate formula for determining hybridization conditions, he or she can determine whether the nucleic acid molecule will hybridize with a given gene under stringent hybridization conditions and to similarly whether the nucleic acid molecule will hybridize under conditions designed to allow a desired amount of base pair mismatch.

Hybridization reactions are often carried out by attaching the nucleic acid molecule to be hybridized to a solid support such as a membrane, and then hybridizing with a labeled nucleic acid molecule, typically referred to as a probe, suspended in a hybridization solution. Examples of common hybridization reaction techniques include, but are not limited to, the well-known Southern and northern blotting procedures. Typically, the actual hybridization reaction is done under non-stringent conditions, i.e., at a lower temperature and/or a higher salt concentration, and then high stringency is achieved by washing the membrane in a solution with a higher temperature and/or lower salt concentration in order to achieve the desired stringency.

For example, if the skilled artisan wished to identify a nucleic acid molecule that hybridizes under conditions that would allow less than or equal to 30% pair mismatch with a flea nucleic acid molecule of about 150 bp in length or greater, the following conditions could preferably be used. The average G+C content of flea DNA is about 37%, as calculated from known flea nucleic acid sequences. The unknown nucleic acid molecules would be attached to a support membrane, and the 150 bp probe would be labeled, e.g. with a radioactive tag. The hybridization reaction could be carried out in a solution comprising 2× SSC in the absence of helix destabilizing compounds, at a temperature of about 37° C. (low stringency conditions). Solutions of differing concentrations of SSC can be made by one of skill in the art by diluting a stock solution of 20× SSC (175.3 gram NaCl and about 88.2 gram sodium citrate in 1 liter of water, pH 7) to obtain the desired concentration of SSC. The skilled artisan would calculate the washing conditions required to allow up to 30% base pair mismatch. For example, in a wash solution comprising 1×SSC in the absence of helix destabilizing compounds, the $T_m$ of perfect hybrids would be about 77° C.:

$$81.5° C.+16.6 \log(0.15 M)+(0.41\times0.37)-(500/150)-(0.61\times0)=77.5° C.$$

Thus, to achieve hybridization with nucleic acid molecules having about 30% base pair mismatch, hybridization washes would be carried out at a temperature of less than or equal to 47.5° C. It is thus within the skill of one in the art to calculate additional hybridization temperatures based on the desired percentage base pair mismatch, formulae and G/C content disclosed herein. For example, it is appreciated by one skilled in the art that as the nucleic acid molecule to be tested for hybridization against nucleic acid molecules of the present invention having sequences specified herein becomes longer than 150 nucleotides, the $T_m$ for a hybridization reaction allowing up to 30% base pair mismatch will not vary significantly from 47.5° C.

Furthermore, it is known in the art that there are commercially available computer programs for determining the degree of similarity between two nucleic acid or protein sequences. These computer programs include various known methods to determine the percentage identity and the number and length of gaps between hybrid nucleic acid molecules or proteins. Preferred methods to determine the percent identity among amino acid sequences and also among nucleic acid sequences include analysis using one or more of the commercially available computer programs designed to compare and analyze nucleic acid or amino acid sequences. These computer programs include, but are not limited to, the SeqLab® Wisconsin Package™ Version 10.0-UNIX sequence analysis software (hereinafter referred to as "SeqLab"), available from Genetics Computer Group, Madison, Wis.; and DNAsis® sequence analysis software, version 2.0, available from Hitachi Software, San Bruno, Calif. Such software programs represent a collection of algorithms paired with a graphical user interface for using the algorithms. The DNAsis version 2.0 software and SeqLab Wisconsin Package Version 10.0-UNIX software, for example, employ a particular algorithm, the Needleman-Wunsch algorithm to perform pair-wise comparisons between two sequences to yield a percentage identity score, see Needleman, S. B. and Wunch, C. D., 1970, *J. Mol. Biol.*, 48, 443, which is incorporated herein by reference in its entirety. Such algorithms, including the Needleman-Wunsch algorithm, are commonly used by those skilled in the nucleic acid and amino acid sequencing art to compare sequences. A preferred method to determine percent identity among amino acid sequences and also among nucleic acid sequences includes using the Needleman-Wunsch algorithm, available in the SeqLab Wisconsin Package Version 10.0-UNIX software (hereinafter "SeqLab"), using the Pairwise Comparison/Gap function with the nwsgapdna.cmp scoring matrix, the gap creation penalty and the gap extension penalties set at default values, and the gap shift limits set at maximum (hereinafter referred to as "SeqLab default parameters"). An additional preferred method to determine percent identity among amino acid sequences and also among nucleic acid sequences includes using the Higgins-Sharp algorithm, available in the DNAsis version 2.0 software (hereinafter "DNAsis"), with the gap penalty set at 5, the number of top diagonals set at 5, the fixed gap penalty set at 10, the k-tuple set at 2, the window size set at 5, and the floating gap penalty set at 10. A particularly preferred method to determine percent identity among amino acid sequences and also among nucleic acid sequences includes using the Needleman-Wunsch algorithm available in the SeqLab software, using the SeqLab default parameters.

A preferred flea HMT and/or HNC protein includes a protein encoded by a nucleic acid molecule that hybridizes under conditions that preferably allow less than or equal to 30% base pair mismatch, preferably under conditions that allow less than or equal to 25% base pair mismatch, preferably under conditions that allow less than or equal to 20% base pair mismatch, preferably under conditions that allow less than or equal to 15% base pair mismatch, preferably under conditions that allow less than or equal to 10% base pair mismatch and preferably under conditions that allow less than or equal to 5% base pair mismatch with a nucleic acid molecule selected from the group consisting of a nucleic acid sequence complementary to a nucleic acid sequence of Table I and/or Table II.

Another embodiment of the present invention includes a flea HMT and/or HNC protein encoded by a nucleic acid molecule that hybridizes under conditions comprising, (a) hybridizing in a solution comprising 1×SSC in the absence of helix destabilizing compounds, at a temperature of 37° C. and (b) washing in a solution comprising 1×SSC in the absence of helix destabilizing compounds, at a temperature of 47.50° C., to an isolated nucleic acid molecule selected from the group consisting of a nucleic acid sequence complementary to a nucleic acid sequence of Table I and/or Table II.

Another preferred flea HMT and/or HNC protein of the present invention includes a protein that is encoded by a nucleic acid molecule that is preferably at least 70% identical, preferably at least 75% identical, preferably at least 80% identical, preferably at least 85% identical, preferably at least 90% identical, and preferably at least 95% identical to a nucleic acid molecule having a nucleic acid sequence of Table I and/or Table II; also preferred are fragments (i.e. portions) of such proteins encoded by nucleic acid molecules that are at least 18 nucleotides. Percent identity as used herein is determined using the Compare function by maximum matching within the program DNAsis Version 2.1 using default parameters.

Additional preferred flea HMT and/or HNC proteins of the present invention include proteins having an amino acid sequence encoded by a nucleic acid sequence of Table I and/or Table II, and proteins comprising homologues of a protein encoded by a nucleic acid sequence of Table I and/or Table II, wherein such a homologue comprises at least one epitope that elicits an immune response against a protein encoded by a nucleic acid sequence of Table I and/or Table II.

In one embodiment, a preferred flea HMT or HNC protein comprises an amino acid sequence of at least 6 amino acids, preferably at least 10 amino acids, preferably at least 15 amino acids, preferably at least 20 amino acids, preferably at least 25 amino acids, preferably at least 30 amino acids, preferably at least 35 amino acids, preferably at least 40 amino acids, preferably at least 50 amino acids, preferably at least 100 amino acids, preferably at least 200 amino acids, preferably at least 250 amino acids, preferably at least 300 amino acids, preferably at least 350 amino acids, and preferably at least 375 amino acids. In another embodiment, preferred flea HMT and HNC proteins comprise full-length proteins, i.e., proteins encoded by full-length coding regions, or post-translationally modified proteins thereof, such as mature proteins from which initiating methionine and/or signal sequences or "pro" sequences have been removed.

A fragment of an HMT and/or HNC protein of the present invention preferably comprises at least 5 amino acids, preferably at least 10 amino acids, preferably at least 15 amino acids, preferably at least 20 amino acids, preferably at least 25 amino acids, preferably at least 30 amino acids, preferably at least 35 amino acids, preferably at least 40 amino acids, preferably at least 45 amino acids, preferably at least 50 amino acids, preferably at least 55 amino acids, preferably at least 60 amino acids, preferably at least 65 amino acids, preferably at least 70 amino acids, preferably at least 75 amino acids, preferably at least 80 amino acids, preferably at least 85 amino acids, preferably at least 90 amino acids, preferably at least 95 amino acids, and preferably at least 100 amino acids in length.

In another embodiment, a preferred flea HMT and/or HNC protein of the present invention is encoded by a nucleic acid molecule comprising at least 15 nucleotides, preferably at least 18 nucleotides, preferably at least 20 nucleotides, preferably at least 25 nucleotides, preferably at least 30 nucleotides, preferably at least 40 nucleotides, preferably at least 50 nucleotides, preferably at least 100 nucleotides, preferably at least 150 nucleotides, preferably at least 350 nucleotides, preferably at least 450 nucleotides, preferably at least 550 nucleotides, preferably at least 650 nucleotides, preferably at least 750 nucleotides, preferably at least 1000 nucleotides, and preferably at least 1100 nucleotides in length. In another embodiment, preferred flea HMT and HNC proteins of the present invention are encoded by nucleic acid molecules comprising apparently full-length HMT or HNC coding regions respectively, i.e., nucleic acid molecules encoding an apparently full-length HMT or HNC proteins.

Preferred flea HMT and HNC proteins of the present invention can be used to develop inhibitors that, when administered to an animal in an effective manner, are capable of protecting that animal from flea infestation. In accordance with the present invention, the ability of an inhibitor of the present invention to protect an animal from flea infestation refers to the ability of that protein to, for example, treat, ameliorate and/or prevent infestation caused by fleas. In particular, the phrase "to protect an animal from flea infestation" refers to reducing the potential for flea population expansion on and around the animal (i.e., reducing the flea burden). Preferably, the flea population size is decreased, optimally to an extent that the animal is no longer bothered by fleas. A host animal, as used herein, is an animal from which fleas can feed by attaching to and feeding through the skin of the animal. Fleas, and other ectoparasites, can live on a host animal for an extended period of time or can attach temporarily to an animal in order to feed. At any given time, a certain percentage of a flea population can be on a host animal whereas the remainder can be in the environment of the animal. Such an environment can include not only adult fleas, but also flea eggs and/or flea larvae. The environment can be of any size such that fleas in the environment are able to jump onto and off of a host animal. For example, the environment of an animal can include plants, such as crops, from which fleas infest an animal. As such, it is desirable not only to reduce the flea burden on an animal per se, but also to reduce the flea burden in the environment of the animal.

Suitable fleas to target include any flea that is essentially incapable of causing disease in an animal administered an inhibitor of the present invention. As such, fleas to target include any flea that produces a protein that can be targeted by an inhibitory compound that inhibits a flea HMT or HNC protein function, thereby resulting in the decreased ability of the parasite to cause disease in an animal. Preferred fleas to target include fleas of the following genera: *Ctenocephalides, Cyopsyllus, Diamanus (Oropsylla), Echidnophaga, Nosopsyllus, Pulex, Tunga,* and *Xenopsylla*, with those of the to species *Ctenocephalides canis, Ctenocephalidesfelis, Diamanus montanus, Echidnophaga gallinacea, Nosopsyllusfaciatus, Pulex irritans, Pulex simulans, Tunga penetrans* and *Xenopsylla cheopis* being more preferred, with *C. felis* being preferred. Such fleas are also preferred for the isolation of proteins or nucleic acid molecules of the present invention.

One embodiment of a flea HMT and/or HNC protein of the present invention is a fusion protein that includes a flea HMT and/or HNC protein-containing domain attached to one or more fusion segments. Suitable fusion segments for use with the present invention include, but are not limited to, segments that can: enhance a protein's stability; act as an immunopotentiator to enhance an immune response against a flea HMT and/or HNC protein; and/or assist in purification of a flea HMT and/or HNC protein (e.g., by affinity chromatography). A suitable fusion segment can be a domain of any size that has the desired function (e.g., imparts increased stability, imparts increased immunogenicity to a protein, and/or simplifies purification of a protein). Fusion segments can be joined to amino and/or carboxyl termini of the flea HMT-containing and/or HNC-containing domain of the protein and can be susceptible to cleavage in order to enable straight-forward recovery of a flea HMT and/or HNC protein. Fusion proteins are preferably produced by culturing a recombinant cell transformed with a fusion nucleic acid molecule that encodes a protein including the fusion segment attached to either the carboxyl and/or amino terminal end of an HMT-containing and/or HNC-containing domain. Preferred fusion segments include a metal binding domain (e.g., a poly-histidine segment); an immunoglobulin binding domain (e.g., Protein A; Protein G; T cell; B cell; Fc receptor or complement protein antibody-binding domains); a sugar binding domain (e.g., a maltose binding domain); and/or a "tag" domain (e.g., at least a portion of β-galactosidase, a strep tag peptide, a T7 tag peptide, a Flag peptide, or other domains that can be purified using compounds that bind to the domain, such as monoclonal antibodies). More preferred fusion segments include metal binding domains, such as a poly-histidine segment; a maltose binding domain; a strep tag peptide, such as that available from Biometra in Tampa, Fla.; and an S10 peptide.

The present invention also includes mimetopes of flea HMT and/or HNC proteins of the present invention. As used herein, a mimetope of a flea HMT and/or HNC protein of the present invention refers to any compound that is able to mimic the activity of such an HMT and/or HNC protein, often because the mimetope has a structure that mimics the particular HMT and/or HNC protein. Mimetopes can be, but are not limited to: peptides that have been modified to decrease their susceptibility to degradation such as all-D retro peptides; anti-idiotypic and/or catalytic antibodies, or fragments thereof; non-proteinaceous immunogenic portions of an isolated protein (e.g., carbohydrate structures); and synthetic or natural organic molecules, including nucleic acids. Such mimetopes can be designed using computer-generated structures of proteins of the present invention. Mimetopes can also be obtained by generating random samples of molecules, such as oligonucleotides, peptides or other organic molecules, and screening such samples by affinity chromatography techniques using the corresponding binding partner.

Another embodiment of the present invention is an isolated nucleic acid molecule comprising a flea HMT and/or HNC nucleic acid molecule, i.e. a nucleic acid molecule that can be isolated from a HMT cDNA library, from a HNC cDNA library, or from both libraries. As used herein, HMT and HNC nucleic acid molecules has the same meaning as HMT and/or HNC nucleic acid molecule. The identifying characteristics of such nucleic acid molecules are heretofore described. A nucleic acid molecule of the present invention can include an isolated natural flea HMT and/or HNC gene or a homologue thereof, the latter of which is described in more detail below. A nucleic acid molecule of the present invention can include one or more regulatory regions, full-length or partial coding regions, or combinations thereof. The minimal size of a nucleic acid molecule of the present invention is a size sufficient to allow the formation of a stable hybrid (i.e., hybridization under stringent hybridization conditions) with the complementary sequence of another nucleic acid molecule. As such, the minimal size of a HMT and/or HNC nucleic acid molecule of the present invention is from 12 to 18 nucleotides in length.

Suitable and preferred fleas from which to isolate nucleic acid molecules of the present invention are disclosed herein. Particularly preferred HMT and/or HNC nucleic acid molecules include C. felis HMT and/or HNC nucleic acid molecules.

In accordance with the present invention, an isolated nucleic acid molecule is a nucleic acid molecule that has been removed from its natural milieu (i.e., that has been subjected to human manipulation) and can include DNA, RNA, or derivatives of either DNA or RNA. As such, "isolated" does not reflect the extent to which the nucleic acid molecule has been purified. Isolated flea HMT and/or HNC nucleic acid molecules of the present invention, or homologues thereof, can be isolated from a natural source or produced using recombinant DNA technology (e.g., polymerase chain reaction (PCR) amplification or cloning) or chemical synthesis. Isolated flea HMT and/or HNC nucleic acid molecules, and homologues thereof, can include, for example, natural allelic variants and nucleic acid molecules modified by nucleotide insertions, deletions, substitutions, and/or inversions in a manner such that the modifications do not substantially interfere with the nucleic acid molecule's ability to encode a HMT and/or HNC protein of the present invention.

A flea HMT and/or HNC nucleic acid molecule homologue can be produced using a number of methods known to those skilled in the art, see, for example, Sambrook et al., ibid., is incorporated by reference herein in its entirety. For example, nucleic acid molecules can be modified using a variety of techniques including, but not limited to, classic mutagenesis and recombinant DNA techniques such as site-directed mutagenesis, chemical treatment, restriction enzyme cleavage, ligation of nucleic acid fragments, PCR amplification, synthesis of oligonucleotide mixtures and ligation of mixture groups to "build" a mixture of nucleic acid molecules, and combinations thereof. Nucleic acid molecule homologues can be selected by hybridization with flea HMT and/or HNC nucleic acid molecules or by screening the function of a protein encoded by the nucleic acid molecule (e.g., ability to elicit an immune response against at least one epitope of a flea HMT or HNC protein or to effect HMT or HNC activity).

An isolated nucleic acid molecule of the present invention can include a nucleic acid sequence that encodes at least one flea HMT or HNC protein of the present invention, examples of such proteins being disclosed herein. Although the phrase "Nucleic acid molecule" primarily refers to the physical nucleic acid molecule and the phrase "nucleic acid sequence" primarily refers to the sequence of nucleotides on the nucleic acid molecule, the two phrases can be used interchangeably, especially with respect to a nucleic acid molecule, or a nucleic acid sequence, being capable of encoding a flea HMT or HNC protein.

A preferred nucleic acid molecule of the present invention, when administered to an animal, is capable of protecting that animal from flea infestation. As will be disclosed in more detail below, such a nucleic acid molecule can be, or encode, an antisense RNA, a molecule capable of triple helix formation, a ribozyme, or other nucleic acid-based drug compound. In additional embodiments, a nucleic acid molecule of the present invention can encode a protective protein (e.g., an HMT or HNC protein of the present invention), the nucleic acid molecule being delivered to the animal, for example, by direct injection (i.e., as a genetic vaccine) or in a vehicle such as a recombinant virus vaccine or a recombinant cell vaccine.

In one embodiment of the present invention, a preferred flea HMT and/or HNC nucleic acid molecule includes an isolated nucleic acid molecule that hybridizes under conditions that preferably allow less than or equal to 30% base pair mismatch, preferably under conditions that allow less than or equal to 25% base pair mismatch, preferably under conditions that allow less than or equal to 20% base pair mismatch, preferably under conditions that allow less than or equal to 15% base pair mismatch, preferably under conditions that allow less than or equal to 10% base pair mismatch and preferably under conditions that allow less than or equal to 5% base pair mismatch with a nucleic acid molecule of Table I and/or Table II and/or a nucleic acid molecule that is complementary to a nucleic acid molecule of Table I and/or Table II.

Another embodiment of the present invention includes a HMT and/or HNC nucleic acid molecule, wherein said nucleic acid molecule hybridizes, in a solution comprising 1× SSC in the absence of helix destabilizing compounds, at a temperature of 47.5° C., to an isolated nucleic acid molecule a nucleic acid molecule of Table I or Table II and/or a nucleic acid molecule that is complementary to a nucleic acid molecule of Table I or Table II. Additional preferred nucleic acid molecules of the present invention include oligonucleotides of an isolated nucleic acid molecule, wherein said nucleic acid molecule hybridizes, in a solution comprising 1× SSC in the absence of helix destabilizing compounds, at a temperature of 47.5° C., to an isolated nucleic acid molecule of Table I or Table II and/or a nucleic acid molecule that is complementary to a nucleic acid molecule of Table I or Table II, wherein said oligonucleotide comprises at least 18 nucleotides.

Additional preferred flea HMT and/or HNC nucleic acid molecules of the present invention include nucleic acid molecules comprising a nucleic acid sequence that is preferably at least 70%, preferably at least 75%, preferably at least 80% preferably at least 85%, preferably at least 90%, and preferably at least 95% identical to a nucleic acid sequence of Table I or Table II and/or a nucleic acid molecule that is complementary to a nucleic acid molecule of Table I or Table II. Also preferred are oligonucleotides of any of such nucleic acid molecules. Percent identity may be determined using the SeqLab sequence analysis software, using default parameters.

Another preferred nucleic acid molecule of the present invention includes at least a portion of nucleic acid sequence of Table I or Table IT, as well as allelic variants of nucleic acid molecules having these nucleic acid sequences and homologues of nucleic acid molecules having these nucleic acid sequences; preferably such a homologue encodes or is complementary to a nucleic acid molecule that encodes at least one epitope that elicits an immune response against a protein encoded by a nucleic acid molecule of Table I and/or Table II. Such nucleic acid molecules can include nucleotides in addition to those included in the SEQ ID NOs, such as, but not limited to, a full-length gene, a full-length coding region, a nucleic acid molecule encoding a fusion protein, or a nucleic acid molecule encoding a multivalent protective compound.

In one embodiment, HMT and/or HNC nucleic acid molecule of the present invention encodes a protein that is at least 70%, preferably at least 75%, preferably at least 80%, preferably at least 85%, preferably at least 90%, preferably at least 95%, preferably at least 98%, and preferably at least 100% identical to a protein encoded by a nucleic acid molecule having a sequence of Table I and/or Table II.

In one embodiment, a HMT and/or HNC nucleic acid molecule of the present invention encodes a protein having an amino acid sequence that is at least 70%, preferably at least 75%, preferably at least 80%, preferably at least 85%, preferably at least 90%, preferably at least 95%, preferably at least 98%, and preferably at least 100% identical to a protein encoded by a nucleic acid molecule having a sequence of Table I and/or Table 11. The present invention also includes a HMT and/or HNC nucleic acid molecule encoding a protein having at least a portion of a protein encoded by a nucleic acid molecule having a sequence of Table I and/or Table II, as well as allelic variants of a nucleic acid molecule encoding a protein having these sequences, including nucleic acid molecules that have been modified to accommodate codon usage properties of the cells in which such nucleic acid molecules are to be expressed.

In another embodiment, a preferred flea HMT and/or HNC nucleic acid molecule of the present invention comprises a nucleic acid molecule comprising at least 15 nucleotides, preferably at least 18 nucleotides, preferably at least 20 nucleotides, preferably at least 25 nucleotides, preferably at least 30 nucleotides, preferably at least 40 nucleotides, preferably at least 50 nucleotides, preferably at least 100 nucleotides, preferably at least 150 nucleotides, preferably at least 350 nucleotides, preferably at least 450 nucleotides, preferably at least 550 nucleotides, preferably at least 650 nucleotides, preferably at least 750 nucleotides, preferably at least 1000 nucleotides, and preferably at least 1100 nucleotides in length.

In another embodiment, a preferred flea HMT and/or HNC nucleic acid molecule encodes a protein comprising at least 5 amino acids, preferably at least 6 amino acids, preferably at least 10 amino acids, preferably at least 15 amino acids, preferably at least 20 amino acids, preferably at least 25 amino acids, preferably at least 30 amino acids, preferably at least 40 amino acids, preferably at least 50 amino acids, preferably at least 100 amino acids, preferably at least 150 amino acids, preferably at least 200 amino acids, preferably at least 300 amino acids, preferably at least 350 amino acids, and preferably at least 350 amino acids in length.

In another embodiment, a preferred flea HMT and/or HNC nucleic acid molecule of the present invention comprises an apparently full-length HMT and/or HNC coding region, i.e., the preferred nucleic acid molecule encodes an apparently full-length HMT and/or HNC protein, or a post-translationally modified protein thereof. In one embodiment, a preferred HMT and/or HNC nucleic acid molecule of the present invention encodes a mature protein.

Knowing the nucleic acid sequences of certain flea HMT and/or HNC nucleic acid molecules of the present invention allows one skilled in the art to, for example, (a) make copies of those nucleic acid molecules, (b) obtain nucleic acid molecules including at least a portion of such nucleic acid molecules (e.g., nucleic acid molecules including full-length genes, full-length coding regions, regulatory control sequences, truncated coding regions), and (c) obtain other flea HMT and/or HNC nucleic acid molecules. Such nucleic acid molecules can be obtained in a variety of ways including screening appropriate expression libraries with antibodies of the present invention; traditional cloning techniques using oligonucleotide probes of the present invention to screen appropriate libraries; and PCR amplification of appropriate libraries or DNA using oligonucleotide primers of the present invention. Preferred libraries to screen or from which to amplify nucleic acid molecules include flea $1^{st}$ instar larvae; $3^{rd}$ instar larvae, wandering larvae, prepupal larvae, pupae and whole adult flea cDNA libraries as well as genomic DNA libraries. Similarly, preferred DNA sources to screen or from which to amplify nucleic acid molecules include flea prepupal cDNA, adult cDNA and genomic DNA. Techniques to clone and amplify genes are disclosed, for example, in Sambrook et al., ibid.

The present invention also includes nucleic acid molecules that are oligonucleotides capable of hybridizing, under stringent hybridization conditions, with complementary regions of other, preferably longer, nucleic acid molecules of the present invention such as those comprising C. felis HMT and/or HNC nucleic acid molecules or other flea HMT and/or HNC nucleic acid molecules. Oligonucleotides of the present invention can be RNA, DNA, or derivatives of either. The minimum size of such oligonucleotides is the size required for formation of a stable hybrid between an oligonucleotide and a complementary sequence on a nucleic acid molecule of the present invention. A preferred oligonucleotide of the present invention has a maximum size of preferably 100 to 200 nucleotides. The present invention includes oligonucleotides that can be used as, for example, probes to identify nucleic acid molecules, primers to produce nucleic acid molecules, or therapeutic reagents to inhibit flea HMT and/or HNC protein production or activity (e.g., as antisense, triplex formation, ribozyme and/or RNA drug-based reagents). The present invention also includes the use of such oligonucleotides to protect animals from disease using one or more of such technologies. Appropriate oligonucleotide-containing therapeutic compositions can be administered to an animal using techniques known to those skilled in the art.

One embodiment of the present invention includes a recombinant vector, which includes at least one isolated nucleic acid molecule of the present invention, inserted into any vector capable of delivering the nucleic acid molecule into a host cell. Such a vector contains heterologous nucleic acid sequences, that is nucleic acid sequences that are not naturally found adjacent to nucleic acid molecules of the present invention and that preferably are derived from a species other than the species from which the nucleic acid molecule(s) are derived. The vector can be either RNA or DNA, either prokaryotic or eukaryotic, and typically is a virus or a plasmid. Recombinant vectors can be used in the cloning, sequencing, and/or otherwise manipulating of flea HMT and/or HNC nucleic acid molecules of the present invention.

One type of recombinant vector, referred to herein as a recombinant molecule, comprises a nucleic acid molecule of the present invention operatively linked to an expression vector. The phrase operatively linked refers to insertion of a nucleic acid molecule into an expression vector in a manner such that the molecule is able to be expressed when transformed into a host cell. As used herein, an expression vector is a DNA or RNA vector that is capable of transforming a host cell and of effecting expression of a specified nucleic acid molecule. Preferably, the expression vector is also capable of replicating within the host cell. Expression vectors can be either prokaryotic or eukaryotic, and are typically viruses or plasmids. Expression vectors of the present invention include any vectors that function (i.e., direct gene expression) in recombinant cells of the present invention, including in bacterial, fungal, parasite, insect, other animal, and plant cells. Preferred expression vectors of the present invention can direct gene expression in bacterial, yeast, insect and mammalian cells, and preferably in the cell types disclosed herein.

In particular, expression vectors of the present invention contain regulatory sequences such as transcription control sequences, translation control sequences, origins of replication, and other regulatory sequences that are compatible with the recombinant cell and that control the expression of nucleic acid molecules of the present invention. In particular, recombinant molecules of the present invention include transcription control sequences. Transcription control sequences are sequences that control the initiation, elongation, and termination of transcription. Particularly important transcription control sequences are those which control transcription initiation, such as promoter, enhancer, operator and repressor sequences. Suitable transcription control sequences include any transcription control sequence that can function in at least one of the recombinant cells of the present invention. A variety of such transcription control sequences are known to those skilled in the art. Preferred transcription control sequences include those that function in bacterial, yeast, or insect and mammalian cells, such as, but not limited to, tac, lac, trp, trc, oxy-pro, omp/lpp, rrnB, bacteriophage lambda (such as lambda $P_L$ and lambda $P_R$ and fusions that include such promoters), bacteriophage T7, T7lac, bacteriophage T3, bacteriophage SP6, bacteriophage SP01, metallothionein, alpha-mating factor, *Pichia* alcohol oxidase, alphavirus subgenomic promoter, antibiotic resistance gene, baculovirus, *Heliothis* zea insect virus, vaccinia virus, herpesvirus, raccoon poxvirus, other poxvirus, adenovirus, cytomegalovirus (such as immediate early promoter), simian virus 40, retrovirus, actin, retroviral long terminal repeat, Rous sarcoma virus, heat shock, phosphate and nitrate transcription control sequences as well as other sequences capable of controlling gene expression in prokaryotic or eukaryotic cells. Additional suitable transcription control sequences include tissue-specific promoters and enhancers as well as lymphokine-inducible promoters (e.g., promoters inducible by interferons or interleukins). Transcription control sequences of the present invention can also include naturally occurring transcription control sequences naturally associated with fleas, such as *C. felis* transcription control sequences.

Suitable and preferred nucleic acid molecules to include in recombinant vectors of the present invention are as disclosed herein. Preferred nucleic acid molecules to include in recombinant vectors, and particularly in recombinant molecules, include nucleic acid molecules having a sequence of Table I and/or Table II.

Recombinant molecules of the present invention may also (a) contain secretory signals (i.e., signal segment nucleic acid sequences) to enable an expressed flea protein of the present invention to be secreted from the cell that produces the protein and/or (b) contain fusion sequences which lead to the expression of nucleic acid molecules of the present invention as fusion proteins. Examples of suitable signal segments include any signal segment capable of directing the secretion of a protein of the present invention. Preferred signal segments include, but are not limited to, tissue plasminogen activator (t-PA), interferon, interleukin, growth hormone, histocompatibility and viral envelope glycoprotein signal segments. Suitable fusion segments encoded by fusion segment nucleic acids are disclosed herein. In addition, a nucleic acid molecule of the present invention can be joined to a fusion segment that directs the encoded protein to the proteosome, such as a ubiquitin fusion segment. Eukaryotic recombinant molecules may also include intervening and/or untranslated sequences surrounding and/or within the nucleic acid sequences of nucleic acid molecules of the present invention.

Another embodiment of the present invention includes a recombinant cell comprising a host cell transformed with one or more recombinant molecules of the present invention. Transformation of a nucleic acid molecule into a cell can be accomplished by any method by which a nucleic acid molecule can be inserted into the cell. Transformation techniques include, but are not limited to, transfection, electroporation, microinjection, lipofection, adsorption, and protoplast fusion. A recombinant cell may remain unicellular or may grow into a tissue, organ or a multicellular organism. It is to be noted that a cell line refers to any recombinant cell of the present invention that is not a transgenic animal. Transformed nucleic acid molecules of the present invention can remain extrachromosomal or can integrate into one or more sites within a chromosome of the transformed (i.e., recombinant) cell in such a manner that their ability to be expressed is retained. Preferred nucleic acid molecules with which to transform a cell include *C. felis* HMT and HNC nucleic acid molecules disclosed herein. Preferred nucleic acid molecules with which to transform a cell include nucleic acid molecules having a sequence of Table I and/or Table II.

Suitable host cells to transform include any cell that can be transformed with a nucleic acid molecule of the present invention. Host cells can be either untransformed cells or cells that are already transformed with at least one nucleic acid molecule (e.g. nucleic acid molecules encoding one or more proteins of the present invention and/or other proteins useful in the production of multivalent vaccines). Host cells of the present invention either can be endogenously (i.e., naturally) capable of producing flea HMT and/or HNC proteins of the present invention or can be capable of producing such proteins after being transformed with at least one nucleic acid molecule of the present invention. Host cells of the present invention can be any cell capable of producing at least one protein of the present invention, and include bacterial, fungal (including yeast), parasite (including helminth, protozoa and ectoparasite), other insect, other animal and plant cells. Preferred host cells include bacterial, mycobacterial, yeast, insect and mammalian cells. More preferred host cells include *Salmonella, Escherichia, Bacillus, Caulobacter, Listeria, Saccharomyces, Pichia, Spodoptera, Mycobacteria, Tri-*

*choplusia*, BHK (baby hamster kidney) cells, MDCK cells (Madin-Darby canine kidney cell line), CRFK cells (Crandell feline kidney cell line), CV-1 cells (African monkey kidney cell line used, for example, to culture raccoon poxvirus), COS (e.g., COS-7) cells, and Vero cells. Particularly preferred host cells are *Escherichia coli*, including *E. coli* K-12 derivatives; *Salmonella typhi; Salmonella typhimurium*, including attenuated strains such as UK-1$_x$3987 and SR-11$_x$4072; Caulobacter; *Pichia; Spodoptera frugiperda; Trichoplusia ni*; BHK cells; MDCK cells; CRFK cells; CV-1 cells; COS cells; Vero cells; and non-tumorigenic mouse myoblast G8 cells (e.g., ATCC CRL 1246). Additional appropriate mammalian cell hosts include other kidney cell lines, other fibroblast cell to lines (e.g., human, murine or chicken embryo fibroblast cell lines), myeloma cell lines, Chinese hamster ovary cells, mouse NIH/3T3 cells, LMTK$^{31}$ cells and/or HeLa cells. In one embodiment, the proteins may be expressed as heterologous proteins in myeloma cell lines employing immunoglobulin promoters.

A recombinant cell is preferably produced by transforming a host cell with one or more recombinant molecules, each comprising one or more nucleic acid molecules of the present invention operatively linked to an expression vector containing one or more transcription control sequences, examples of which are disclosed herein. The phrase operatively linked refers to insertion of a nucleic acid molecule into an expression vector in a manner such that the molecule is able to be expressed when transformed into a host cell.

A recombinant cell of the present invention includes any cell transformed with at least one of any nucleic acid molecule of the present invention. Suitable and preferred nucleic acid molecules as well as suitable and preferred recombinant molecules with which to transfer cells are disclosed herein.

Recombinant cells of the present invention can also be co-transformed with one or more recombinant molecules including flea HMT and/or HNC nucleic acid molecules encoding one or more proteins of the present invention and one or more other nucleic acid molecules encoding other protective compounds, as disclosed herein (e.g., to produce multivalent vaccines).

Recombinant DNA technologies can be used to improve expression of transformed nucleic acid molecules by manipulating, for example, the number of copies of the nucleic acid molecules within a host cell, the efficiency with which those nucleic acid molecules are transcribed, the efficiency with which the resultant transcripts are translated, and the efficiency of post-translational modifications. Recombinant techniques useful for increasing the expression of nucleic acid molecules of the present invention include, but are not limited to, operatively linking nucleic acid molecules to to high-copy number plasmids, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites, Shine-Dalgarno sequences), modification of nucleic acid molecules of the present invention to correspond to the codon usage of the host cell, deletion of sequences that destabilize transcripts, and use of control signals that temporally separate recombinant cell growth from recombinant enzyme production during fermentation. The activity of an expressed recombinant protein of the present invention may be improved by fragmenting, modifying, or derivatizing nucleic acid molecules encoding such a protein.

Isolated flea HMT and/or HNC proteins of the present invention can be produced in a variety of ways, including production and recovery of natural proteins, production and recovery of recombinant proteins, and chemical synthesis of the proteins. In one embodiment, an isolated protein of the present invention is produced by culturing a cell capable of expressing the protein under conditions effective to produce the protein, and recovering the protein. A preferred cell to culture is a recombinant cell of the present invention. Effective culture conditions include, but are not limited to, effective media, bioreactor, temperature, pH and oxygen conditions that permit protein production. An effective, medium refers to any medium in which a cell is cultured to produce a flea HMT and/or HNC protein of the present invention. Such medium typically comprises an aqueous medium having assimilable carbon, nitrogen and phosphate sources, and appropriate salts, minerals, metals and other nutrients, such as vitamins. Cells of the present invention can be cultured in conventional fermentation bioreactors, shake flasks, test tubes, microtiter dishes, and petit plates. Culturing can be carried out at a temperature, pH and oxygen content appropriate for a recombinant cell. Such culturing conditions are within the expertise of one of ordinary skill in the art. Examples of suitable conditions are included in the Examples section.

Depending on the vector and host system used for production, resultant proteins of the present invention may either remain within the recombinant cell; be secreted into the fermentation medium; be secreted into a space between two cellular membranes. Such as the periplasmic space in *E. coli*; or be retained on the outer surface of a cell or viral membrane.

The phrase "recovering the protein", as well as similar phrases, refers to collecting the whole fermentation medium containing the protein and need not imply additional steps of separation or purification. Proteins of the present invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization. Proteins of the present invention are preferably retrieved in "substantially pure" form. As used herein, "substantially pure" refers to a purity that allows for the effective use of the protein as a therapeutic composition or diagnostic. A therapeutic composition for animals, for example, should exhibit no substantial toxicity and preferably should be capable of stimulating the production of antibodies in a treated animal.

The present invention also includes isolated (i.e., removed from their natural milieu) antibodies that selectively bind to a flea HMT and/or HNC protein of the present invention or a mimetope thereof (e.g., anti-*C. felis* HMT or HNC antibodies). As used herein, the term "selectively binds to" an HMT and/or HNC protein refers to the ability of antibodies of the present invention to preferentially bind to specified proteins and mimetopes thereof of the present invention. Binding can be measured using a variety of methods standard in the art including enzyme immunoassays (e.g., ELISA), immunoblot assays, etc.; see, for example, Sambrook et al., ibid., and Harlow, et al., 1988, *Antibodies, a Laboratory Manual*, Cold Spring Harbor Labs Press; Harlow et al., ibid., is incorporated by reference herein in its entirety. An anti-HMT or anti-HNC antibody of the present invention preferably selectively binds to a flea HMT or HNC protein respectively in such a way as to inhibit the function of that protein.

Isolated antibodies of the present invention can include antibodies in serum, or antibodies that have been purified to varying degrees. Antibodies of the present invention can be polyclonal or monoclonal, or can be functional equivalents such as antibody fragments and genetically-engineered antibodies, including single chain antibodies or chimeric antibodies that can bind to one or more epitopes.

A preferred method to produce antibodies of the present invention includes (a) administering to an animal an effective amount of a protein, peptide or mimetope thereof of the present invention to produce the antibodies and (b) recovering the antibodies. In another method, antibodies of the present invention are produced recombinantly using techniques as heretofore disclosed to produce HMT and/or HNC proteins of the present invention. Antibodies raised against defined proteins or mimetopes can be advantageous because such antibodies are not substantially contaminated with antibodies against other substances that might otherwise cause interference in a diagnostic assay or side effects if used in a therapeutic composition.

Antibodies of the present invention have a variety of potential uses that are within the scope of the present invention. For example, such antibodies can be used (a) as therapeutic compounds to passively immunize an animal in order to protect the animal from fleas susceptible to treatment by such antibodies and/or (b) as tools to screen expression libraries and/or to recover desired proteins of the present invention from a mixture of proteins and other contaminants. Furthermore, antibodies of the present invention can be used to target cytotoxic agents to fleas in order to directly kill such fleas. Targeting can be accomplished by conjugating (i.e., stably joining) such antibodies to the cytotoxic agents using techniques known to those skilled in the art. Suitable cytotoxic agents are known to those skilled in the art.

One embodiment of the present invention is a therapeutic composition that, when administered to an animal susceptible to flea infestation, is capable of protecting that animal from flea infestation. Therapeutic compositions of the present invention include at least one of the following protective molecules: an isolated flea HMT and/or HNC protein; a mimetope of an isolated flea HMT and/or HNC protein; an isolated flea HMT and/or HNC nucleic acid molecule; and/or a compound derived from said isolated flea HMT and/or HNC protein that inhibits HMT and/or HNC protein activity. A therapeutic composition of the present invention can further comprise a component selected from the group of an excipient, a carrier, and/or an adjuvant; these components are described further herein. As used herein, a protective molecule or protective compound refers to a compound that, when administered to an animal in an effective manner, is able to treat, ameliorate, and/or prevent flea infestation. Preferred fleas to target are heretofore disclosed. One example of a protective molecule is a vaccine, such as, but not limited to, a naked nucleic acid vaccine, a recombinant virus vaccine, a recombinant cell vaccine, and a recombinant protein vaccine. Another example of a protective molecule is a compound that inhibits HMT and/or HNC protein activity, such as an isolated antibody that selectively binds to a flea HMT and/or HNC protein, a substrate analog of a flea HMT and/or HNC protein, anti-sense-, triplex formation-, ribozyme-, and/or KNA drug-based compounds, or other inorganic or organic molecules that inhibit HMT and/or HNC protein activity. Inhibiting flea HMT and/or HNC protein activity can refer to the ability of a compound to reduce the activity of flea HMT and/or HNC proteins. Inhibiting flea HMT and/or HNC protein activity can also refer to the ability of a compound to reduce the amount of flea HMT and/or HNC protein in a flea.

Another embodiment of the present invention includes a method to reduce a flea infestation in an animal susceptible to flea infestation. Such a method includes the step of administering to the animal a therapeutic molecule comprising a protective compound selected from the group consisting of (a) an isolated flea HMT and/or HNC protein; (b) a mimetope of an isolated flea HMT and/or HNC protein; (c) an isolated flea HMT and/or HNC nucleic acid molecule; and (d) a compound derived from an isolated flea HMT and/or HNC protein that inhibits HMT and/or HNC protein activity.

Therapeutic compositions of the present invention can be administered to any animal susceptible to flea infestation, preferably to mammals, and preferably to dogs, cats, humans, ferrets, horses, cattle, sheep, and other pets, economic food animals, work animals and/or zoo animals. Preferred animals to protect against flea infestation include dogs, cats, humans, and ferrets, with dogs and cats being particularly preferred.

As used herein, the term derived, or the term derived from, refers to a peptide, antibody, mimetope, nucleic acid molecule, or other compound that was obtained from or obtained using a flea HMT and/or HNC protein or nucleic acid molecule of the present invention. Methods to obtain derivatives from a HMT and/or HNC molecule of the present invention are known in the art, and as such include, but are not limited to molecular modeling of HMT and/or HNC proteins to determine active sites, i.e. sites that interact with other molecules, and predicting from these active sites smaller fragments and/or mimetopes that retain and/or mimic these active sites, thereby inhibiting HMT and/or HNC protein activity; screening of peptide or small chemical compound libraries against HMT and/or HNC proteins of the present invention; and screening of polyclonal or monoclonal antibodies to find antibodies that specifically bind HMT and/or HNC proteins of the present invention.

An EMT and/or HNC protein inhibitor of the present invention is identified by its ability to bind to, modify, or otherwise interact with, a flea HMT and/or HNC protein, thereby inhibiting the activity of HMT and/or HNC proteins. Suitable inhibitors of HMT and/or HNC protein activity are compounds that inhibit HMT and/or HNC protein activity in at least one of a variety of ways: (a) by binding to or otherwise interacting with or otherwise modifying HMT and/or HNC protein sites; (b) by binding to the HMT to and/or HNC protein and thus reducing the availability of the HMT and/or HNC protein in solution; and (c) by interacting with other regions of the HMT and/or HNC protein to inhibit HMT and/or HNC protein activity, for example, by allosteric interaction.

Flea HMT and/or HNC protein inhibitors can be used directly as compounds in compositions of the present invention to treat animals as long as such compounds are not harmful to host animals being treated. Preferred HMT and/or HNC protein inhibitors of the present invention include, but are not limited to, flea HMT and/or HNC protein substrate analogs, and other molecules that bind to a flea HMT and/or HNC proteins (e.g., to an allosteric site) in such a manner that the activity of the flea HMT and/or HNC protein is inhibited. An HMT and/or HNC protein substrate analog refers to a compound that interacts with (e.g., binds to, associates with, modifies) the active site of a HMT and/or HNC protein. A preferred HMT and/or HNC protein substrate analog inhibits HMT and/or HNC protein activity. HMT and/or HNC protein substrate analogs can be of any inorganic or organic composition. HMT and/or HNC protein substrate analogs can be, but need not be, structurally similar to a HMT and/or HNC protein natural substrate as long as they can interact with the active site of that HMT and/or HNC protein. HMT and/or HNC protein substrate analogs can be designed using computer-generated structures of HMT and/or HNC proteins of the present invention or computer structures of HMT and/or HNC protein's natural substrates. Preferred sites to model include one or more of the active sites of IMT and/or HNC protein. Substrate analogs can also be obtained by generating random samples of molecules, such as oligonucleotides, peptides, peptidomimetic compounds, or other inorganic or organic molecules, and screening such samples for their ability to interfere with interaction between HMT and/or HNC proteins and their substrates, e.g. by affinity chromatography techniques. A preferred HMT and/or HNC protein substrate analog is a HMT and/or HNC protein mimetic compound, i.e., a compound that is structurally and/or functionally similar to a natural substrate of a HMT and/or HNC protein of the present invention, particularly to the region of the substrate that interacts with the HMT and/or HNC protein active site, but that inhibits HMT and/or HNC protein activity upon interacting with the HMT and/or HNC protein active site.

The present invention also includes a therapeutic composition comprising at least one protective molecule of the present invention in combination with at least one additional compound protective against one or more infectious agents.

In one embodiment, a therapeutic composition of the present invention can be used to protect an animal from flea infestation by administering such composition to a flea in order to prevent infestation. Such administration to the flea and/or animal could be oral, or by application to the animal's body surface (e.g. topical spot-on, or spraying onto the animal), or by application to the environment (e.g., spraying). Examples of such compositions include, but are not limited to, transgenic vectors capable of producing at least one therapeutic composition of the present invention. In another embodiment a flea can ingest therapeutic compositions, or products thereof, present on the surface of or in the blood of a host animal that has been administered a therapeutic composition of the present invention.

In accordance with the present invention, a host animal (i.e., an animal that is or is capable of being infested with fleas) is treated by administering to the animal a therapeutic composition of the present invention in such a manner that the composition itself (e.g., a HMT and/or HNC protein, a HMT and/or HNC nucleic acid molecule, a HMT and/or HNC protein inhibitor, a HMT and/or HNC protein synthesis suppressor (i.e., a compound that decreases the production or half-life of a HMT and/or HNC protein in fleas), a HMT and/or HNC protein mimetope, or a anti-HMT and/or HNC antibody) or a product generated by the animal in response to administration of the composition (e.g., antibodies produced in response to administration of a flea HMT and/or HNC protein or nucleic acid molecule, or conversion of an inactive inhibitor "prodrug" to an active HMT and/or HNC protein inhibitor) ultimately enters the flea, A host animal is preferably treated in such a way that the compound or product thereof is present on the body surface of the animal or enters the blood stream of the animal. Fleas are then exposed to the composition or product when they feed from the animal. For example, flea HMT and/or HNC protein inhibitors administered to an animal are administered in such a way that the inhibitors enter the blood stream of the animal, where they can be taken up by feeding fleas.

The present invention also includes the ability to reduce larval flea infestation in that when fleas feed from a host animal that has been administered a therapeutic composition of the present invention, at least a portion of compounds of the present invention, or products thereof, in the blood taken up by the fleas are excreted by the fleas in feces, which is subsequently ingested by flea larvae. In particular, it is of note that flea larvae obtain most, if not all, of their nutrition from flea feces.

In accordance with the present invention, reducing HMT and/or HNC protein activity in a flea can lead to a number of outcomes that reduce flea burden on treated animals and their surrounding environments. Such outcomes include, but are not limited to, (a) reducing the viability of fleas that feed from the treated animal, (b) reducing the fecundity of female fleas that feed from the treated animal, (c) reducing the reproductive capacity of male fleas that feed from the treated animal, (d) reducing the viability of eggs laid by female fleas that feed from the treated animal, (e) altering the blood feeding behavior of fleas that feed from the treated animal (e.g., fleas take up less volume per feeding or feed less frequently), (f) reducing the viability of flea larvae, for example due to the feeding of larvae from feces of fleas that feed from the treated animal, (g) altering the development of flea larvae (e.g., by decreasing feeding behavior, inhibiting growth, inhibiting (e.g., slowing or blocking) molting, and/or otherwise inhibiting maturation to adults), and/or (h) altering or decreasing the ability of fleas or flea larvae to digest a blood meal.

In order to protect an animal from flea infestation, a therapeutic composition of the present invention is administered to the animal in an effective manner such that the composition is capable of protecting that animal from flea infestation. Therapeutic compositions of the present invention can be administered to animals prior to infestation in order to prevent infestation (i.e., as a preventative vaccine) and/or can be administered to animals after infestation. For example, proteins, mimetopes thereof, and antibodies thereof can be used as immunotherapeutic agents.

Therapeutic compositions of the present invention can be formulated in an excipient that the animal to be treated can tolerate. Examples of such excipients include water, saline, Ringer's solution, dextrose solution, Hank's solution, and other aqueous physiologically balanced salt solutions. Non-aqueous vehicles, such as fixed oils, sesame oil, ethyl oleate, or triglycerides may also be used. Other useful formulations include suspensions containing viscosity enhancing agents, such as sodium carboxymethylcellulose, sorbitol, or dextran. Excipients can also contain minor amounts of additives, such as substances that enhance isotonicity and chemical stability. Examples of buffers include phosphate buffer, bicarbonate buffer and Tris buffer, while examples of preservatives include thimerosal, or o-cresol, formalin and benzyl alcohol. Standard formulations can either be liquid injectables or solids which can be taken up in a suitable liquid as a suspension or solution for injection. Thus, in a non-liquid formulation, the excipient can comprise dextrose, human serum albumin, preservatives, etc., to which sterile water or saline can be added prior to administration.

In one embodiment of the present invention, a therapeutic composition can include an adjuvant. Adjuvants are agents that are capable of enhancing the immune response of an animal to a specific antigen. Suitable adjuvants include, but are not limited to, cytokines, chemokines, and compounds that induce the production of cytokines and chemokines (e.g., granulocyte macrophage colony stimulating factor (GM-CSF), Flt-3 ligand, granulocyte colony stimulating factor (G-CSF), macrophage colony stimulating factor (M-CSF), colony stimulating factor (CSF), erythropoietin (EPO), interleukin 2 (IL-2), interleukin-3 (IL-3), interleukin 4 (IL-4), interleukin 5 (IL-5), interleukin 6 (IL-6), interleukin 7 (IL-7), interleukin 8 (IL-8), interleukin 10 (IL-10), interleukin 12 (IL-12), interferon gamma, interferon gamma inducing factor I (IGIF), transforming growth factor beta, RANTES (regulated upon activation, normal T cell expressed and presumably secreted), macrophage inflammatory proteins (e.g., MIP-1 alpha and MEW-1 beta), and *Leishmania* elongation initiating factor (LEIF)); bacterial components (e.g., endotoxins, in particular superantigens, exotoxins and cell wall components); aluminum-based salts; calcium-based salts; silica; polynucleotides; toxoids; serum proteins, viral coat proteins; block copolymer adjuvants (e.g., Hunters Titer-rnax™ adjuvant (Vaxcel™, Inc. Norcross, Ga.), Ribi adjuvants (Ribi ImmunoChem Research, Inc., Hamilton, Mont.); and saponins and their derivatives (e.g., Quil A (Superfos Biosector A/S, Denmark). Protein adjuvants of the present invention can be delivered in the form of the protein themselves or of nucleic acid molecules encoding such proteins using the methods described herein.

In one embodiment of the present invention, a therapeutic composition can include a carrier. Carriers include compounds that increase the half-life of a therapeutic composition in the treated animal. Suitable carriers include, but are not limited to, polymeric controlled release vehicles, biodegradable implants, liposomes, bacteria, viruses, other cells, oils, esters, and glycols.

One embodiment of the present invention is a controlled release formulation that is capable of slowly releasing a composition of the present invention into an animal. As used herein, a controlled release formulation comprises a composition of the present invention in a controlled release vehicle. Suitable controlled release vehicles include, but are not limited to, biocompatible polymers, other polymeric matrices, capsules, microcapsules, microparticles, bolus preparations, osmotic pumps, diffusion devices, liposomes, lipospheres, and transdermal delivery systems. Other controlled release formulations of the present invention include liquids that, upon administration to an animal, form a solid or a gel in situ. Preferred controlled release formulations are biodegradable (i.e., bioerodible).

A preferred controlled release formulation of the present invention is capable of releasing a composition of the present invention into the blood of the treated animal at a constant rate sufficient to attain therapeutic dose levels of the composition to protect an animal from flea infestation. The therapeutic composition is preferably released over a period of time ranging from about 1 to about 12 months. A controlled release formulation of the present invention is capable of effecting a treatment preferably for at least 1 month, preferably for at least 3 months, preferably for at least 6 months, preferably for at least 9 months, and preferably for at least 12 months.

Acceptable protocols to administer therapeutic compositions in an effective manner include individual dose size, number of doses, frequency of dose administration, and mode of administration. Determination of such protocols can be accomplished by those skilled in the art. A suitable single dose is a dose that is capable of protecting an animal from disease when administered one or more times over a suitable time period. For example, a preferred single dose of a protein, mimetope or antibody therapeutic composition, including a recombinant protein vaccine, is from about 1 microgram (μg) to about 10 milligrams (mg) of the therapeutic composition per kilogram body weight of the animal. Booster vaccinations can be administered from about 2 weeks to several years after the original administration. Booster administrations preferably are administered when the immune response of the animal becomes insufficient to protect the animal from disease. A preferred administration schedule is one in which from about 10 μg to about 1 mg of the therapeutic composition per kg body weight of the animal is administered from about one to about two times over a time period of from about 2 weeks to about 12 months. Modes of administration can include, but are not limited to, subcutaneous, intradermal, intravenous, intranasal, oral, transdermal, intraocular, intranasal, conjunctival, and intramuscular routes. Methods of administration for other therapeutic compounds can be determined by one skilled in the art, and may include administration of a therapeutic composition one or more times, on a daily, weekly, monthly or yearly regimen; routes of administration can be determined by one skilled in the art, and may include any route. A preferred route of administration of an inhibitory compound when administering to fleas is a topical, or "spot-on" formulation administered to the body surface of the animal, so that a flea would encounter the inhibitory compound when attached to the animal; another preferred route of administration of an inhibitory compound is an oral formulation that, when fed to an animal, would enter the bloodstream of the animal, which would then be transferred to a flea while feeding from the animal.

A recombinant protein vaccine of the present invention comprises a recombinantly-produced flea HMT and/or HNC protein of the present invention that is administered to an animal according to a protocol that results in the animal producing a sufficient immune response to protect itself from a flea infestation. Such protocols can be determined by those skilled in the art.

According to one embodiment, a nucleic acid molecule of the present invention can be administered to an animal in a fashion to enable expression of that nucleic acid molecule into a protective protein or protective RNA (e.g., antisense RNA, ribozyme, triple helix forms or RNA drug) in the animal. Nucleic acid molecules can be delivered to an animal in a variety of methods including, but not limited to, (a) administering a naked (i.e., not packaged in a viral coat or cellular membrane) nucleic acid as a genetic vaccine (e.g., as naked DNA or RNA molecules, such as is taught, for example in Wolff et al., 1990, *Science* 247, 1465-1468) or (b) administering a nucleic acid molecule packaged as a recombinant virus vaccine or as a recombinant cell vaccine (i.e., the nucleic acid molecule is delivered by a viral or cellular vehicle).

A genetic (i.e., naked nucleic acid) vaccine of the present invention includes a nucleic acid molecule of the present invention and preferably includes a recombinant molecule of the present invention that preferably is replication, or otherwise amplification, competent. A genetic vaccine of the present invention can comprise one or more nucleic acid molecules of the present invention in the form of, for example, a dicistronic recombinant molecule. Preferred genetic vaccines include at least a portion of a viral genome, i.e., a viral vector. Preferred viral vectors include those based on alphaviruses, poxviruses, adenoviruses, herpesviruses, picornaviruses, and retroviruses, with those based on alphaviruses, such as sindbis or Semliki forest virus, species-specific herpesviruses and poxviruses being particularly preferred. Any suitable transcription control sequence can be used, including those disclosed as suitable for protein production. Particularly preferred transcription control sequences include cytomegalovirus immediate early (preferably in conjunction with Intron-A), Rous sarcoma virus long terminal repeat, and tissue-specific transcription control sequences, as well as transcription control sequences endogenous to viral vectors if viral vectors are used. The incorporation of a "strong" polyadenylation signal is also preferred.

Genetic vaccines of the present invention can be administered in a variety of ways, with intramuscular, subcutaneous, intradermal, transdermal, conjunctival, intraocular, intranasal and oral routes of administration being preferred. A preferred single dose of a genetic vaccine ranges from about 1 nanogram (ng) to about 600 μg, depending on the route of administration and/or method of delivery, as can be determined by those skilled in the art. Suitable delivery methods include, for example, by injection, as drops, aerosolized and/or topically. Genetic vaccines of the present invention can be contained in an aqueous excipient (e.g., phosphate buffered saline) alone or in a carrier (e.g., lipid-based vehicles).

A recombinant virus vaccine of the present invention includes a recombinant molecule of the present invention that is packaged in a viral coat and that can be expressed in an animal after administration. Preferably, the recombinant molecule is packaging- or replication-deficient and/or encodes an attenuated virus. A number of recombinant viruses can be used, including, but not limited to, those based on alphaviruses, poxviruses, adenoviruses, herpesviruses, picornaviruses, and retroviruses. Preferred recombinant virus vaccines are those based on alphaviruses (such as Sindbis virus), raccoon poxviruses, species-specific herpesviruses and species-specific poxviruses. An example of methods to produce and use alphavirus recombinant virus vaccines are disclosed in U.S. Pat. No. 5,766,602 to Xiong and Grieve, which is incorporated by reference herein in its entirety.

When administered to an animal, a recombinant virus vaccine of the present invention infects cells within the immunized animal and directs the production of a protective protein or RNA nucleic acid molecule that is capable of protecting the animal from flea infestation as disclosed herein. For example, a recombinant virus vaccine comprising a flea HMT and/or HNC nucleic acid molecule of the present invention is administered according to a protocol that results in the animal producing a sufficient immune response to protect itself from flea infestation. A preferred single dose of a recombinant virus vaccine of the present invention is from about $1\times10^4$ to about $1\times10^8$ virus plaque forming units (pfu) per kilogram body weight of the animal. Administration protocols are similar to those described herein for protein-based vaccines, with subcutaneous, intramuscular, intranasal, intraocular, conjunctival, and oral administration routes being preferred.

A recombinant cell vaccine of the present invention includes recombinant cells of the present invention that express at least one protein of the present invention. Preferred recombinant cells for this embodiment include *Salmonella*, *E. coli*, *Listeria*, *Mycobacteriuni*, *S. frugiperda*, yeast, (including *Saccharomyces cerevisiae* and *Pichia pastoris*), BHK, CV-1, myoblast G8, COS (e.g., COS-7), Vero, MDCK and CRFK recombinant cells. Recombinant cell vaccines of the present invention can be administered in a variety of ways but have the advantage that they can be administered orally, preferably at doses ranging from about $10^8$ to about $10^{12}$ cells per kilogram body weight. Administration protocols are similar to those described herein for protein-based vaccines. Recombinant cell vaccines can comprise whole cells, cells stripped of cell walls or cell lysates.

The efficacy of a therapeutic composition of the present invention to protect an animal from flea infestation can be tested in a variety of ways including, but not limited to, detection of protective antibodies (using, for example, proteins or mimetopes of the present invention), detection of cellular immunity within the treated animal, or challenge of the treated animal with the fleas to determine whether the treated animal is resistant to infestation. Challenge studies can include direct administration of fleas to the treated animal. In one embodiment, therapeutic compositions can be tested in animal models such as mice. Such techniques are known to those skilled in the art.

One therapeutic composition of the present invention includes an inhibitor of flea HMT and/or HNC protein activity, i.e., a compound capable of substantially interfering with the function of a flea HMT and/or HNC protein susceptible to inhibition by an inhibitor of flea HMT and/or HNC protein activity. An inhibitor of HMT and/or HNC protein activity can be identified using flea HMT and/or HNC proteins of the present invention. An inhibitor of HMT and/or HNC protein function can be identified using flea HMT and/or HNC proteins of the present invention. A preferred inhibitor of HMT and/or HNC protein function is a compound capable of substantially interfering with the function of a flea HMT and/or HNC protein and which does not substantially interfere with host animal proteins. As used herein, a compound that does not substantially inhibit or interfere with host animal proteins is one that, when administered to a host animal, the host animal shows no significant adverse effects attributable to the compound and which, when administered to an animal in an effective manner, is capable of protecting that animal from flea infestation.

One embodiment of the present invention is a method to identify a compound capable of inhibiting HMT and/or HNC protein activity of a flea. Such a method includes the steps of (a) contacting (e.g., combining, mixing) an isolated flea HMT and/or HNC protein, preferably a *C. felis* HMT and/or HNC protein of the present invention, with a putative inhibitory compound under conditions in which, in the absence of the compound, the protein has HMT and/or HNC protein activity, and (b) determining if the putative inhibitory compound inhibits the activity. HMT and/or HNC protein activity can be determined in a variety of ways known in the art, including but not limited to determining the ability of HMT and/or HNC protein to bind to or otherwise interact with a substrate. Such conditions under which a HMT and/or HNC protein has HMT and/or HNC protein activity include conditions in which a HMT and/or HNC protein has a correct three-dimensionally folded structure under physiologic conditions, i.e. physiologic pH, physiologic ionic concentrations, and physiologic temperatures.

Putative inhibitory compounds to screen include antibodies (including fragments and mimetopes thereof), putative substrate analogs, and other, preferably small, organic or inorganic molecules. Methods to determine HMT and/or HNC protein activity are known to those skilled in the art; see, for example, the Examples section of the present application. Methods to determine binding of a putative inhibitory compound to a HMT and/or HNC protein of the present invention are known to those of skill in the art and include, for example, determining changes in molecular mass using surface plasmon resonance (e.g., determining light scatter by an inhibitor of a HMT and/or HNC protein, before and after contacting the inhibitor or protein with a HMT and/or HNC protein or inhibitor, respectively) or screening for compounds that inhibit interaction between a HMT and/or HNC protein and a substrate.

A preferred method to identify a compound capable of inhibiting HMT and/or HNC protein activity includes contacting an isolated flea HMT and/or HNC protein encoded by a nucleic acid molecule of Table I and/or Table II; (b) a protein comprising an at least 25 consecutive amino acid portion identical in sequence to a consecutive amino acid portion of a sequence as set forth in (a), wherein the protein has HMT and/or HNC protein activity; (c) a protein comprising a fragment of a protein as set forth in (a), wherein the fragment has an activity selected from the group consisting of binding to a HMT and/or HNC molecule and hydrolyzing a HMT and/or HNC protein substrate; and (d) a protein encoded by an allelic variant of a nucleic acid molecule that encodes any protein of (a), (b), or (c), with a putative inhibitory compound under conditions in which, in the absence of the compound, the protein has HMT and/or HNC protein activity; and determining if the putative inhibitory compound inhibits the activity.

Another embodiment of the present invention is an assay kit to identify an inhibitor of a flea HMT and/or HNC protein of the present invention. This kit comprises an isolated flea HMT and/or HNC protein of the present invention, and a means for determining inhibition of an activity of flea HMT and/or HNC protein, where the means enables detection of inhibition. Detection of inhibition of flea HMT and/or HNC protein identifies a putative inhibitor to be an inhibitor of flea HMT and/or HNC protein. Means for determining inhibition of flea HMT and/or HNC protein include an assay system that detects binding of a putative inhibitor to a flea HMT and/or HNC molecule, and an assay system that detects interference by a putative inhibitor of the ability of flea HMT and/or HNC protein to hydrolyze a substrate. Means and methods are described herein and are known to those skilled in the art.

The following examples are provided for the purposes of illustration and are not intended to limit the scope of the present invention. The following examples include a number of recombinant DNA and protein chemistry techniques known to those skilled in the art; see, for example, Sambrook et al., ibid.

EXAMPLE 1

This Example describes the isolation of RNA from the hindgut and Malpighian tubules (HMT) of *Ctenocephalides felis* and the use of isolated RNA to construct to subtracted and unsubtracted EDNA libraries.

Approximately 10,000 hindguts and Malpighian tubules were dissected from equal numbers of cat blood fed and unfed adult *C. felis* with a male to female ratio of 1 to 4, and total RNA was extracted using a guanidine isothiocyanate lysis buffer and the standard procedure described by Sambrook et al. Poly-A enriched mRNA was purified from total RNA above using a mRNA Purification Kit, available from Pharmacia Biotech, Piscataway, N.J., following the manufacturer's protocol. The same procedures were used to extract total RNA and isolate poly-A enriched mRNA from the dissected *C. felis* bodies following removal of HMT, referred to hereinafter as "non-HMT mRNA".

Poly-A enriched mRNA was used to construct a cDNA library using subtractive hybridization and suppression PCR as follows. Subtractive hybridization and suppression PCR was conducted using a PCR-Select™ cDNA Subtraction Kit, available from Clontech Laboratories, Inc., Palo Alto, Calif. according to the manufacturer's instructions. Briefly, this kit uses subtractive hybridization and suppression PCR to specifically amplify cDNA sequences that are present in the tester cDNA and absent in the driver cDNA, thus enriching for tester-specific sequences. The efficiency of the subtraction process can be assessed by semi-quantitative PCR and by comparing the ethidium bromide staining patterns of the subtracted and unsubtracted samples on agarose gels as described in section V.D. of the manufacturer's protocol. For the semi-quantitative PCR, three genes with mRNAs known to be expressed outside of the HMT tissue were used to test for specific subtraction. These genes encoded putative actin, N-aminopeptidase, and serine protease proteins.

Subtractive hybridization and suppression PCR was conducted under the following conditions. Two micrograms (µg) of HMT mRNA was used as the template for synthesis of the tester material and 2 µg of non-HMT mRNA was used as template for synthesis of the driver material in this reaction. The number of cycles used in the selective amplification steps was optimized using the manufacturer's protocols. Optimization resulted in the use of 24 rather than the standard 27 cycles of primary PCR in combination with 15 cycles of secondary PCR rather than the standard 12 cycles.

The products from the suppressive PCR reaction were ligated into the pCR®2.1 vector, available from Invitrogen, Carlsbad, Calif., using an Original TA Cloning® Kit, available from Invitrogen. The ligation reaction was then used to transform INVαF' One Shot™ competent cells, available from Invitrogen, which were plated on Luria broth (LB) agar with 50 micrograms per milliliter (µg/ml) ampicillin, available from Sigma-Aldrich Co., St. Louis, Mo., and 50 µg/ml 5-bromo-4-chloro-3-indoyl β-D-galactopyranoside (X-Gal), available from Fisher Biotech, Fair Lawn, N.J. Transformed colonies were amplified and the DNA isolated using the standard alkaline lysis procedure described by Sambrook et al., ibid.

Automated cycle sequencing of DNA samples was performed using an ABI PRISM™ Model 377, available from Perkins Elmer, with XL upgrade DNA Sequencer, available from PE Applied Biosystems, Foster City, Calif., after reactions were carried out using the PRISM™ Dye Terminator Cycle Sequencing Ready Reaction Kit or the PRISM™ dRhodamine Terminator Cycle Sequencing Ready Reaction Kit or the PRISM™ BigDye™ Terminator Cycle sequencing Ready Reaction Kit, available from PE Applied Biosystems, following the manufacturer's protocol, hereinafter "standard sequencing methods". The resulting sequences are presented in Table II. Sequence analysis was performed using the MacVector™ sequence analysis software, available from International Biotechnologies Inc., New Haven, Conn., and the SeqLab sequence analysis software, using default parameters. Each sequence read was trimmed of vector sequence at either end and submitted for a search through the National Center for Biotechnology Information (NCBI), National Library of Medicine, National Institute of Health, Baltimore, Md., using the BLAST network. This database includes SwisProt+PIR+SPupdate+GenPept+GPUpdate+PDB databases. The search was conducted using the xBLAST function, which compares the translated sequences in all 6 reading frames to the protein sequences contained in the database.

An unsubtracted HMT cDNA library was constructed as follows. Approximately 10,000 HMT tissues were dissected from equal numbers of unfed and cat blood-fed adult *C. felis* with a male to female ratio of 1:4. Total KNA was extracted using a guanidine isothiocyanate lysis buffer and procedures described in Sambrook et al., followed by isolation using a mRNA purification kit, available from Pharmacia, according to the manufacturer's protocols. The library was constructed with 5 µg of isolated mRNA using a ZAP-cDNA® cDNA synthesis kit, and packaged using a ZAP-cDNA® Gigapack® gold cloning kit, both available from Stratagene, La Jolla, Calif. The resultant HMT library was amplified to a titer of about 5×10$^9$ plaque forming units per milliliter (pfu/ml). Single clone excisions were performed using the Ex-Assist™ helper phage, available from Stratagene, and used to create double stranded plasmid template for sequencing using the manufacturer's protocols with the following exceptions. Following incubation of the SOLR cells with the cleared phage lysate, the mixture was used to inoculate LB broth, and the mix was incubated overnight and then subjected to mini-prep plasmid preparation and sequencing as described for the subtracted HMT library above.

EXAMPLE 2

This Example describes the isolation of RNA from the head and nerve cord (HNC) of *Ctenocephalides felis* and the use of isolated RNA to construct subtracted and unsubtracted cDNA libraries.

Approximately 4,000 heads and attached nerve cords, including the terminal abdominal ganglia were dissected from equal numbers of cat blood-fed and unfed adult C. felis with a male to female ratio of 1 to 4, and total RNA was extracted using a guanidine isothiocyanate lysis buffer and the standard procedure described by Sambrook et al. Approximately 618 µg of total RNA was recovered. Poly-A enriched mRNA was purified from total RNA above using a mRNA Purification Kit, available from Pharmacia, following the manufacturer's protocol. Approximately 13 µg of mRNA was isolated. The same procedures were used to extract total RNA and isolate poly-A enriched mRNA from the dissected C. felis bodies following removal of HNC tissues, referred to hereinafter as "non-HNC mRNA".

Suppression subtractive PCR was conducted as described in Example 1 using a PCR-Select™ cDNA Subtraction kit, available from Clontech, under the following conditions. Two micrograms (µg) of HNC mRNA was used as the template for synthesis of the tester material and 2 µg of non-HMT mRNA was used as template for synthesis of the driver material in this reaction. The number of cycles used in the selective amplification steps was optimized using the manufacturer's protocols. Optimization resulted in the use of 24 rather than the standard 27 cycles of primary PCR in combination with either 12 or 15 cycles of secondary PCR.

cDNA pools from various PCR cycling combinations were ligated into the TA vector using a TA cloning kit, available from Invitrogen. Aliquots of ligation reaction were transformed into Ultramax DH5α™ bacteria, available from Gibco-BRL, Gaithersburg, Md. Portions of the transformation mixes were used to inoculate LB broth cultures containing 100 µg/ml of ampicillin. The overnight cultures were plated to generate discreet colonies which were used individually for overnight cultures for plasmid preps. Transformed colonies were amplified and the DNA isolated using the standard alkaline lysis procedure described by Sambrook et al., ibid.

Automated cycle sequencing of DNA samples was performed using the standard sequencing methods described in Example 1. The resulting sequences are presented in Table I. Sequence analysis was performed using the MacVector™ sequence analysis software, available from International Biotechnologies Inc., New Haven, Conn., and the SeqLab sequence analysis software, using default parameters.

An unsubtracted EDNA library was constructed as follows. Approximately 6400 head and nerve cords were dissected from C. felis and poly-A RNA was isolated as described above. About seven µg of HNC poly-A RNA was used to construct a cDNA library using Stratagene's λZAP-cDNA Synthesis Kit and protocol. The resultant HNC library was amplified to a titer of about $5 \times 10^9$ plaque forming units per milliliter (pfu/ml). Single clone excisions were performed using the Ex-Assist helper phage, available from Stratagene, and used to create double stranded plasmid template for sequencing using the manufacturer's protocols with the following exceptions. Following incubation of the SOLR cells with the cleared phage lysate, the mixture was used to inoculate LB broth, and the mix was incubated overnight and then subjected to mini-prep plasmid preparation and sequencing as described for the subtracted library above.

While various embodiments of the present invention have been described in detail, it is apparent that modifications and adaptations of those embodiments will occur to those skilled in the art. It is to be expressly understood, however, that such modifications and adaptations are within the scope of the present invention, as set forth in the following claims:

SEQUENCE LISTING (2313 sequences)

SEQ ID NO: 1 - DNA, 549 bp, Ctenocephalides felis
cagattcaggacagtgtttattaatatactgcggtttactgaaattttataaatatgaaagtctttttcattttcttttgtttatgcctgattattcttaatgaactggatgcgatgcgagtaattccaggaggtcgatatggaaaacacaactacaaaggaaaacagcctgagaaaaatacaatataggaacccggcagctattaactattatgaccacaaagatggagccaaaatagttaagtcatcacacttcgaattagattacatgttaggaagaaaaatcacattcttctgcatggctcaaggattaccgcgaccttcaataacttggtttaaggatggagttgagttatttcatcatcgatttttccaagttcatgaatggccatgggaaatgatactttgaaatctaaaatggaaatcgatcctacgacccaaaaagatgcaggatattacgaatgctggcagacaatcaatatgcaatagatagacgaggatttcgacagattacgactgattgttattaaatattcatattgatatatg

SEQ ID NO: 2 - DNA, 549 bp, Ctenocephalides felis
aaattttcttttaataagaaaaatttattattaagtttattaattttagaatataaagctttaattatatttttaattttatatttttgttttaattatataatatttgagaattatttttgtaatttttatattgtatttacagtatgtgaaggggttttaggcctttctattttagttgcaataattccgtactcatggtaatgattattttaaaagatttaatataatacaatgttaaaatttttaataataatattttttataatccctattattttattaaaaaattgttattgattggttcaaacaatattatttataatattatttatttatataattttaggaataaaaagaattataattgttaatattagattaaattttggttatgatattatatcttatagattgaatttattaaggatttgaattattattttaatattaatagcatcaattttaatttataaaaataattataatttaaattatttttattattattaattttttattattaatattatttttacctttagtcat

SEQ ID NO: 3 - DNA, 485 bp, Ctenocephalides felis
  misc_feature (129)..(129): n = unknown at position 129
  misc_feature (154)..(154): n = unknown at position 154
  misc_feature (296)..(296): n = unknown at position 296
  misc_feature (316)..(316): n = unknown at position 316
  misc_feature (475)..(475): n = unknown at position 475
ggtcgtatgcacgcacctggaaagggtatctcccaatctgctttgccttaccgtcgtggagtccccacttggttaaaattgaatggagaagatgtcaaagaacagatttttaaacttggaaagatggtnttactccatcacaaatctggtgttntcttaagggattctcatggggtcgcccaagttcgatttgtcagtggcaacaaaatcttgcgtatcatgaaagccatgggagtagcccctgaattacctgaagatttatactatttgatcaagaaggctgtagctatccgcangcatttggaaaggaaccgcnaggacaaagacagcaaattccgtttgattcttgagaatccagaattcacagacttgcccgttactacaaaacaaagagcatcttggacccaactggaaatacgaatccagcactgatctgacttgtagctaagatgttaatgaatgtgaagttatatantaaatgtgaa

SEQ ID NO: 4 - DNA, 485 bp, Ctenocephalides felis
ctaaaaatctagttcaaaatgcgtgaatgtatctcaatccatgttggccaagctggtgtccaaattggaaacgcctgttgggagttgtactgtttggaacatggcattcagcctgatggccaaatgccatctgacaaaactattggaggcggtgatgactctttcaacacctttttcagtgagacaggggcaggcaagcatgtgccacgagctgtctttgttgatttggaaccaactgttgtagatgaggtccgcactggaacataccgtcaattattccacccagaacaactgattactggcaaggaagatgctgccaacaattatgcacgtggtcactacacaattggcaaagaaatcgttgatgttgtattggcagaattcgaaattgctgatcaatgcactgtctgcaaggtttctcatttcactccttggagggggcaccggtcaggatcacctcctgtcatggacgtctgctgtgctat

SEQ ID NO: 5 - DNA, 500 bp, Ctenocephalides felis
acacatagcaaattaagtcttcgcttggatttacatgaaaattgccaaaaaaagaatacattcattataggaagtatttattcaagtattttttgatgactgttctagctgttcatcaattcatacttaaaatagttaccctttttaatttttacagtatttaaatttaatagttggtatagtattttataaattttaatttgaagcattcctttataggtttggaaattatatttttacaaaaaaaaataacccgtccaattgattttaaacaaaaccataaaaaactaggtgctatagtaaacagcatttgatttgatgtatacattgcattgaaatgagtggagaagcaagatgaaagcctatccattaatgacttaagactttttagaaatgttttatatatacatatgtatgctagatatttagatggtgtcttgtaattgaattagatttacaaggaaccaaatgttctacattaaaactaaatttatctctat

SEQ ID NO: 6 - skipped

SEQ ID NO: 7 - DNA, 198 bp, Ctenocephalides felis
  misc_feature (143)..(143): n = unknown at position 143
  misc_feature (167)..(167): n = unknown at position 167
acatttagctctatcggaatatctgaatatctgaatatctgaatatctgaatatccgaatatccgaatatccgaatatccgaatatccggatatccgaatatccgaatatccgaatatccgaatatccgaatatccgaatatncgaatatccgaatatccgaatatncgaatatccgaatatccgaatatccgaatat

SEQ ID NO: 8 - DNA, 485 bp, Ctenocephalides felis
  misc_feature (475)..(475): n = unknown at position 475
gttttttgtttaacacttttgaataaaacaaaatatacaatggcggacgtagatgttcaaatgcaattcacaacaaccacgaccaaaacgcgtaaagtgaagaagtcgtccaagaggcgcgaatctagcgaccatggtgaagttactattacagagatggagaacggacaccaacagcaaggtggcgagtacaccaaggccatgaacaaggactggcactctggtcacttctgctgctggcaatgcgacgagtcactgaccggccaacgctacgtactccgcgacgaacatccttactgcatcaagtgctacgagagcgtcttttccaacacctgcgaggaatgcagcaagatcattggcattgattccaaggacttatcttacaaagaaaagcattggcatgaggcatgtttcttgtgcagtaaatgccgcgttcttcgtcgtaacagttcggaagtaatggacaaattactgnggaactgtat

SEQ ID NO: 9 - DNA, 549 bp, Ctenocephalides felis
aaggatggagtcactgtagcgaagggtattgatctcaaggacaaatttcagaatattggggccaaattagtccaagatgtagctaataacaccaatgaagaagctggtgatggtactactactgctactgtgcttgccagagctattgcaaaggaaggctttgaaaaaatatctaaaggagcaaatcccattgaaatcagacgaggtgttatgctggctgttgatgcagtcaaagaatctttgaaaggaatgtcgaagcctgttactaccccggaggaaattgcacaagttgctaccatttctgccaatggagacaaagctattggaaaattgatctcagatgcaatgaagcgtgttggaaaggaaggtgtaataacggttaaagatggaaaaactttacatgatgaacttgaggtcattgagggcatgaagtttgatagaggatcatttcaccttactttatgaattccagcaaaggtgctaaagtagaattccaagatccttattttgtcagtgacaaaaaatactcagtcaagcatattctgcttg

SEQ ID NO: 10 - DNA, 549 bp, Ctenocephalides felis
  misc_feature (207)..(207): n = unknown at position 207
  misc_feature (513)..(513): n = unknown at position 513
  misc_feature (515)..(515): n = unknown at position 515
acgccaggctatgcttcaagccaccaaggatgccaacaagaagggccccaacttcaccatcaccaaaaaggacagcaacttcaacatgtcttctgcccaaattgaaagaaacaagaccaaggaacaattggaagaggaaaagaaaatttctctgtccttccgtatcaagcctctggatatcgaatctcttagcgttgaaaaactcanacaaaaggccaatgaactttgggaatgcatcgtcaagttggaaactgagaaatacgatctggaggaacgccaaaaacgccaggactacgatcttaaagaattgaaagaaaggcagaaacaacaactcagacacaaagcattgaagaaaggattggatccagaagccctcacaggaaaatcccacccaaaatccaagtcgctccaaatatgagagacgtgtcgcacaagatcatatgatgataagaaaaaattatttgaaggcggttcgcacattgtctctgaagtaatgaaaagtctggaacagcntncaactattcagaaacgtagtaaactagcttctaa

SEQ ID NO: 11 - DNA, 87 bp, Ctenocephalides felis
aatttccagcgcgctcagtaccaccacgtcgagacgatcaaccgatgcgcctttcgaaccccagttagcgtactggttggcgctgat

SEQ ID NO: 12 - DNA, 268 bp, Ctenocephalides felis
  misc_feature (30)..(31): n = unknown at positions 30 and 31
acggtttacaccctagtcgcgcctaaagannttttatttaaaaacaaattgtattacttttaacaagtttctctacaaatttgagaaaaccatgttgtatttttaactactagtgtaatatttttgttaaaatatattatttttgtctgtcccaaacgaatgattttcctgcggccctgcctgttgcagatattcctacacacgttattataagtcacgctgtttgcgcgccgtagcaattacgcgccccgttcgcgccgttcgttgt

SEQ ID NO: 13 - DNA, 436 bp, Ctenocephalides felis
attttaaattttttataaaaataatatttaaaattataaaaaatatgaaataatgattaaattagtataatataatttattgataatattaaattgttaggtttatttaaggaattcggcaaatataatattcacctgtttaacaaaaacatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattattttaagaatattattaaatttatttatattaatatatttatt

SEQ ID NO: 14 - DNA, 324 bp, Ctenocephalides felis
accttgaatagtaataattatctctttcaggacccccatttcgaatcaatattataattaaaccttctactttcagtgctgatgtatcctttatctatatatatgcaattagcaattgtataatttatatataaatgtgtatactttcgtaggttatggtagcgcatttccacattatccaattttaagttcacaaaagtctctaatgtaagtcgtgtcttgtgtgtttcgtagagaatttagtcggacaattgtaaaatgtcaaatagacttgtaaaagacaaagttatgtagtggttctaaagtagtgatattgtgtcgagt

SEQ ID NO: 15 - DNA, 391 bp, Ctenocephalides felis
  misc_feature (385)..(385): n = unknown at position 385
caagtctttacggatatcaacatcacatttcattatggagttgtaagtggtttcatggattccacaggcttccattcccaagaatgatggctggaagagagcttctgggcacctgaacctttcatttccaatggtgatgacttgtccgtcaggaagttcgtatgatttttctaaagatgaagagctggcagcggtggccatttcttgttcgaagtccaaagctacatagcacaatttttctttaatatcacggacaatttctctttcggcagtagtggtgaaggagtatccacgttcagttaagattttcattaaataatcagttaagtcacgggcagccaagtccaaacgcaagataacgtgagggaaggcgtatccttcatanattggt

SEQ ID NO: 16 - DNA, 440 bp, Ctenocephalides felis
  misc_feature (100)..(100): n = unknown at position 100
  misc_feature (123)..(123): n = unknown at position 123
  misc_feature (132)..(132): n = unknown at position 132
  misc_feature (162)..(162): n = unknown at position 162
  misc_feature (178)..(178): n = unknown at position 178
  misc_feature (182)..(182): n = unknown at position 182
  misc_feature (184)..(184): n = unknown at position 184
  misc_feature (248)..(248): n = unknown at position 248
  misc_feature (286)..(286): n = unknown at position 286
  misc_feature (342)..(342): n = unknown at position 342
  misc_feature (403)..(403): n = unknown at position 403
aatattattgtattatttaggcagcaggacattcaagagttccatcatttatgtcatctattaagtcatgtggtgccctgccatcaatggtgcatcctanactttgggctgttcccaaaaccnctttaaacnttcccgaaaattcaccaaccaagggaccanggcccaattggggggnaaancncaactatgtcatcaaaagtgatattgccattgtgtttaatgttcttttgcttcttgcggtcacnagggggttccttcaatgctttaataactaaagaggcanctgaaggtactactgaaattgttgcttgcctgttttggatggacaattgaacagtnattttcaaacccttccaatccccggtagccttagcaatatcatcaccaactttctttgganacagaccaatggaccaattttgggggcaaaggatgat

SEQ ID NO: 17 - DNA, 498 bp, Ctenocephalides felis
  misc_feature (399)..(399): n = unknown at position 399
  misc_feature (448)..(448): n = unknown at position 448
  misc_feature (462)..(462): n = unknown at position 462
  misc_feature (486)..(486): n = unknown at position 486
aatcaataagaatattggggccagttccatcaggaccaaagcaccagattttacgagcttcagttacatcataatcatattgttcaccaagataacgagcacgagctttgaattcatcacgggggttgacttttccactgtcgatgtcttctgcgaggccatcaggcataggttgtgccttcatgaataatctgttgtgcttgtttggagatttagacaagcacatttggtctgattcttcagatacagtttctctgtaagatacaacagggtcagatttctttaatggaatgcaagcatggtcttcttccaaatctttcaagcaaatttccaagtgcaattcaccggcaccagcaatgatgtgttcaccagattcttcaatgatacattggaccatangatctgatttaaccagacgtttcaaaccttctaccaattttggcagatnagcaaggtttttangttcaacagcaacacgcacaacangagaaactgaga

SEQ ID NO: 18 - DNA, 498 bp, Ctenocephalides felis
aaccactggtgctcgtgtgttcggagccatgaagggtgctgttgatggtggcttaaatattccacactccactaagcgtttcccaggttatgatgctgaaagcaaaagcttcaatgctgaagtgcacagagctcacatctttggaaaacatgtagctgactacatgaaatctcttgaagaggaagatgaagatgcattcaaacgtcaatttagcaaatacatcagtcttggaattactgctgataatattgaagagctatacaagaaagcccatgcggccattagagctgatccttcattgaaacctgcagataaaatgaaggcagctgatgtcaaggtgaaacgttggaaccgggctaaactttcactctctgaacgcaagaatcgcgttgcccaaaagaaagcttcatggcttcagaagctcaaagcagagaatgaggcataaatgacttctaaatatataaatgtttatattactttgaaataaaccggtaaaat

SEQ ID NO: 19 - DNA, 488 bp, Ctenocephalides felis
gccgtcagtgtgctggaattcggctttcgagcggccgcccgggcagtacaaatacatttcatcacttgcacacatccttaaattatgaagaacttagttgaacaaaccgaagcccatatcatcatcggactcctctggttcagattccttcttcttttcctccttagcagcagcagctggtgctgcagctccaccggcagcagcaggggcagcggctgctggtccggatccaactcctgaaccgatgttggtgatcaggtcttttacgtttactccttccaaagccttggcgaacaatcctggccagtatggctcaacatcgacagctgcagctttcaagatggtagagatcttctcaccagttacagcaacatcatcgtcaaccaatatcagagcggagtaaacgcaagcgagttcagcttttgtggccatttttatatatatttgaaataacttttggtgcaagtcgccgaaatttggtcttagct

SEQ ID NO: 20 - DNA, 321 bp, Ctenocephalides felis
caagaaggttggaattactggtaaatatggaactcgttatggagcttccttacgtaaaatggtcaaaaagatggaaataacccagcacgccaaatacacttgcacattttgtggaaaggatgccatgaaacgcagttgtgttggaatttggtcttgcaaaagatgtaaaagaactgtagctggtggtgcctgggtatataccacaactgctgctgcctctgtccgatctgctgttaggaggttgagagaaacaaaggaacagtaatttatattgatcttaataaataattaataaaaaaaaaaaaaaaaaaaaaaaaaaaa

SEQ ID NO: 21 - DNA, 404 bp, Ctenocephalides felis
tttttttttttttttttttttttttttttttagtttaatgtttattttaaatcataatttacaaatatgattcaggaaattcaaatgttacctcacgtcctgtcaactttttgtaaacggaagtgaacgtatcaactttatgttcaattgtagtttgttgacttttgtccaaatgaactttaatgagctgggatccatctagcttgacacggatacgtttaccaacaatttcagctgggaatactaagtcttctaaaatagcatcatacacagatgtcaaagttctgctacgtggacgcttctgcttattcttagtgcgagttttacgtgttggttttggaaggattttacgctctccaacaaatacaacatgattgccagaaaatttcttctccaactctcgt

SEQ ID NO: 22 - DNA, 269 bp, Ctenocephalides felis
gtgttgagtggtatcaaaacttggtcacccagtttatgagagaagtcttgccacaacatttccaaagcatttgtctggtgtagcaaaacatcgtgcccactccatgggctttcgtagacttcagatactgcttccattaaagacttggaagcactttgcacagctctaatacatcttatgtagttattaaattccttttgcagtctattagcactattttgctgcctggtgaagttttgtaaatgctcatcaaaaatatcatctgcggt

SEQ ID NO: 23 - DNA, 216 bp, Ctenocephalides felis
ggcggctgatgccattagtgggtttgtccagaataagattgtcgatggtgatgttattttaacatttagctgctcatctctaattcaacaaatatttgaagatacttcaaagaacggaattgattttcatgttgtggttgtggatggtcgcccatctctagaaggtagagaaatgctacgcagactcattgaacgtggtatcaagtgttcctatgt

SEQ ID NO: 24 - DNA, 500 bp, Ctenocephalides felis
  misc_feature (230)..(230): n = unknown at position 230
  misc_feature (334)..(334): n = unknown at position 334
  misc_feature (394)..(394): n = unknown at position 394
  misc_feature (459)..(459): n = unknown at position 459
ttttttttttttttttttttttttttaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtcnattcaagattgttttcctggtttaagccttacttagcaatctcacttttgcattcttcgccgggtggcgtgggtatgcatcgcaactccgttttatcaaagtgnaagccatttggacaatcataatgttttatttgccatttgttgttaaccaagaaacattgntaatattttttacaatctcttcgatcggaaaaaacgttttcaacctttgcacgcagttctgcccnagaaagattttgggtcaaaccattcgttgacgtcgtcctca

SEQ ID NO: 25 - DNA, 146 bp, Ctenocephalides felis
ttttccatcaactttgattaaacgctgcataacaatcttcgtaacctcggtattggtcaaagcatatttcaaacggttacgtagaaaaataactaaaggtaaggactcgcgaagtttgtgaggtccagtggatggccgaggtgcgt

SEQ ID NO: 26 - DNA, 498 bp, Ctenocephalides felis
  misc_feature (403)..(403): n = unknown at position 403
ggccctggacaagatgcccttcgactcaccaccgaatatggagctgtctacgatcaaaatgccaccattgaagttcttaataaacagaagaggaaaactttgtgccacactgatggcgaaggagttgaatgcgaaacagaagaagggagcatcgcacctcaaataatactatttgctgcccaattaatttctggagtcggtggatctttatactacactttaggtgtatcctatatggacgataacaccaaaaaatctaaaacaccagcactgataagtttttcttattttcttcgtatgctcggacctgcaaccggttatgccttggctagcgtctgtctaaagttctacatttcgccaacgttgacgccaacaattgataataatgatcctagatggttangagcatggtggttaagttgggtgatactaggatcaactttaatattttttgcaacgttgattggattgtttcctaaaattctgccaagagctgca

SEQ ID NO: 27 - DNA, 489 bp, Ctenocephalides felis
  misc_feature (445)..(445): n = unknown at position 445
aacaatatgtaaccgattccacactatttttaacagaattcaaaattcgtaattgtcaagaaattatttcatctctacagaatgttttatgtgatcaagaagtcaagtatattccaaagcggaaatttgggttcaaaaataaaaagctcttattaaatgataaaattattggtaaggacttggatacaaaaagtaaagatacgacagatttatgtctcaataagtgtaatgattggaatttatcagaatgtggatttcatttaaaggagaatgaaattctatatctttatgctgaacaggttaataaaaaggatattacattgagtagcatatataaatgcactgtaataattactggctatcctaatacttcaaacattcaagacagcactgtgatttgtggtcctgtaactacatcaatatttgctgataaatgcattaatangtaagttagtcattgcttgccagcaattgagactacattcttct

SEQ ID NO: 28 - DNA, 582 bp, Ctenocephalides felis
  misc_feature (422)..(422): n = unknown at position 422
  misc_feature (479)..(479): n = unknown at position 479
  misc_feature (520)..(520): n = unknown at position 520
agctgccaattatagtaattagctactaaagctttccagttaactctggaactgctttaaataaatcagctactaaaccaaagtctgaaacttgaaatatgggtgcctctggatctttattgattgcaacaatagttttagaatctttcattccagctaagtgttgaattgctccagatattccaacagcaatatagagttcaggtgcaacaatcttccctgtctgaccgatttgcatatcatttgggcaaaatccagcatctaccgcggctctagaagcgcctactgcagctcctatcttatccgctaagtcaaataataatttgaaattatcaccagactttaaaccacgtcctcctgatacaatagtcttagcacttgataattcaggcctgtctgatttacttagttcttgggatatnaatgtggtcaaatcgggattatagtcacctctgggaacatctttcacttcagctggngaagaatttaatgcagctgggttcaaagctggtgccacgantagatatgactttagtggatctttcaccttcagtgtctgaatacgttaccggcataaattgt

SEQ ID NO: 29 - DNA, 314 bp, Ctenocephalides felis
  misc_feature (185)..(185): n = unknown at position 185
  misc_feature (258)..(258): n = unknown at position 258
  misc_feature (283)..(283): n = unknown at position 283
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgangagaatatacatgtattgctactaatcaaggcattggaattactgttattctacaaccttggttcgagttcangataaaataactgctttgtggccanttttgggtatctgtgctgaagtaattacttt

SEQ ID NO: 30 - DNA, 133 bp, Ctenocephalides felis
ccgggcaggtacggcctcttgcaaggcttcgtggtgcatttcaacggatttaacttcagtggtcaagttggctggggcaaatacaacaacagtgcctggtttcaagactccagtttcaacacggcctactggt

SEQ ID NO: 31 - DNA, 485 bp, Ctenocephalides felis
  misc_feature (2)..(2): n = unknown at position 2
  misc_feature (216)..(216): n = unknown at position 216
  misc_feature (332)..(332): n = unknown at position 332
  misc_feature (406)..(406): n = unknown at position 406
  misc_feature (463)..(463): n = unknown at position 463
  misc_feature (467)..(467): n = unknown at position 467
angggatctgttctcacgcagattccgcacccgaggagtcatccctctgtctacttatatgaaagtgtataaagtgggagacatagtagacataaagggtaatggtgctgtgcagaaaggtatgccttataaagcctaccatggtaaaactggacgtgtttataatgtaacccctcatgcgcttggtgtaatagtaaacaaacgtgtccgtggtanaattattccaaagagaataaatattcgtattgaacacgtaaagcattcaaaatgcagagaagattttttgaaacgtgtgaaggaaaatgaacgtcttcgacatgaagccaaggaanagaaagttcatgttacattgaagagacaacctgctcaacctcggccagcaaatattgtcaaaggaactgatganccaatacgtttggcaccaattccttacgaatttattgcataaatttgtaaactttanatanataattaagatttgtaaa

SEQ ID NO: 32 - DNA, 439 bp, Ctenocephalides felis
gtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgccaaggtcaaggcttgcagagatgacaaacgtgatgaattcaaccaagttcgccaaaatggcttggccgcctggagagaagccagggagaacgccgaagccctcagagcacaagccaaggagtgcgttgtgaccgcagccgatgtcgatgaagccagagtttgcttgaaaggggttctccaagctgcccacgaaggagcaaaagacttggccaaggcactcaaagaaacctggtcccaattgggcaacttagtccgtgaagtcggaaaatgcgcaaggggagccttgaaagaattagggacaacttagt

SEQ ID NO: 33 - DNA, 498 bp, Ctenocephalides felis
  misc_feature (344)..(344): n = unknown at position 344
attacacagaattcgtgcaaagaacactgttttggcgactggtggttatggacgagcatatttttcatgcacttcagcacatacctgcacaggtgatggcaccggtatggtagccagagctggattaccagcacaagatttagaatttgtgcagttccatcctacaggtatttatggagctggctgtttaattactgaaggatgcagaggtgaaggtggatttttggtaaattctcaaggagagagatttatggaacgatatgcacctgttgcaaaagatttggccagtagagatgtggtttctagatcaatgacaattgaaatcaatgaaggtcgcggtgtangacctgagaaagatcacgttttattgcaattacatcacttaccagctgaacaattagcgagcagacttcctggtatttccgagacagctatgatattttgtggtgttgatgttactcgtgagccaatccccgttttaccaacagtgcattataa

SEQ ID NO: 34 - DNA, 427 bp, Ctenocephalides felis
  misc_feature (403)..(403): n = unknown at position 403
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaangagcacaaacaaaatgtcattaac

SEQ ID NO: 35 - DNA, 362 bp, Ctenocephalides felis
cagtgcgggggcacctttgacactcgatttaataaagaaacgggtcacattagttttgcaactgtatgacaaaattgatccagcaaagttgaaattggagtcacactttatcaacgacttaggtttagattccttagatcatgtagaagttattatggccatggaggacgagtttggttttgaaatcccagatggtgatgcagaaaaactgacccgacctgcagatattgttcgatacgtagcagatagagaagatgtttatgaataaactaaataaatggttgatttgtaaaacattttagaataataatttcaatatctgcacaaaaattatgtgcagtttgattatgtctgaaccttgt

SEQ ID NO: 36 - DNA, 462 bp, Ctenocephalides felis
  misc_feature (445)..(445): n = unknown at position 445
  misc_feature (451)..(451): n = unknown at position 451
ttgtcgaattctatgctccatggtgtggacactgcaaagctttagccccagaatacgcaaaagcagccaaacagttagaagatgaaaaatctgaaatcaaacttgccaaagttgatgccactgaagaaggcgatttggctgagaaatatggtgttcgaggatatccaactttaaaattcttccgtagcggaagtgaaattgattatacaggtggacgccaagctgatgacattattacttggttgaaaaagaagactggaccaccagctaaagaactggaatctgttgatgacgccaaagcatttgttgaggaaagccaagttgtcgttattggtttctttaaggatcgtgaatcagctgaagctaaggcattcttgtcaactgctaactctgttgatgattatccatttggtatcacgagcaatgaagaagttataacaattangatttnaatgtgggtca

SEQ ID NO: 37 - skipped

SEQ ID NO: 38 - DNA, 429 bp, Ctenocephalides felis
  misc_feature (286)..(286): n = unknown at position 286
gatcggttgcaatttgtcattgcaccaagcataaattgatggggtccggtgcataggttataaaagaattgggatttgtgcatttcatgacggtgcaatcagcttctgacgatttctttttacacatatttttaaaatgatcatatacataagttaggtgggcattcgaaaacctgacctttaacatctttgcagaataagtatcttgtgcaagtctttcgggatctggctgatatccctacaaaccgcgcatggtagtttctggccgtcttacagttttccccangttttgatgagcacatatcatctacacaaaatggagcatcggatttgagtctctgcaattgattgttgtattggggtttcttgtccagcgcacaacttcaaagtagaacaatcgtgacaaaatgttcccaactgcttattagt

SEQ ID NO: 39 - DNA, 498 bp, Ctenocephalides felis
  misc_feature (426)..(426): n = unknown at 426
tgtatgagagttttgcatcgccaggcgggatttattgctgaagttcaacaaagatgctttcatgtctcgccattaactgccatggccagcaaggtggccatgagcaaattcgacagtgattcttatctgccttatggaaaattatcaagaaaatttaaaagttgttaaaaagcgtttgaacaggccattaactctttccgaaaaagtattatattctcatttagatgaacctgaaaaacaagaaattgaaagaggaactagctacttacgtttaagacccgatagagttgctatgcaagatgctactgctcaaatggccatgttgcaatttatttcatcagggctgcctaaagttgccgttcctagcacgattcattgtgatcatttaatcgaagcacaaatcggaggagatcaagatcttgctanagccaagacattaataaagaagtatacagtttcttatccagtgctagtgctaaatatggggtgggcttttgg

SEQ ID NO: 40 - DNA, 498 bp, Ctenocephalides felis
tgcctgacgaaattctcaaagaagtcgttcctgggtaatataagaaacgcagaacactttgtaggatttctgaaaagatttgtcgaatacatcaaaaccaggcttcgggtacagcatgtcgtgcaggaatcaccagcaggttttctcaaagacatccagtcaaaagtatgcatcgaaagaaagcctctgagattttgtgcagaaagactcgcttctctgcttcggactctggaagtgacggatatgactgattttggagccctggttttgatcacacatttagctacattggtttccacgtatacacatggatttactattattgttgaaccattcgatgataagactccgaatgtttcgaacccgattttgtatttcagttgtttagattcatcattagccatgaggccagttttctcaagatttcaatcagttgtcatcacatcaggaactttgtcacctttggatatgtatccaaagattttggattttcaacct

SEQ ID NO: 41 - DNA, 177 bp, Ctenocephalides felis
aagggcaattttcggtttaaggcatattggaatgaggcattagcgaaatctacaattgaactatcggtgttgaacattcccatggcgactccaggtccttggtaagtgtggacggtgaagctcattggacttcccgattcgggggtaaatgtcaattctaatttaccctttcctggt

SEQ ID NO: 42 - DNA, 211 bp, Ctenocephalides felis
tgttccaatacctccaattttgtagacatcttgcaatggcagacggaggggcttgtcggtgggacgagctggaggtaagatggcatccaaagcttcaatcaagcatttgccgtcagccttgccttctttacgttcaatgttccatcccttgaaccagttcatcttggtggaaacttccaacatgttgtctccgtgccatccagagatgggt

SEQ ID NO: 43 - DNA, 452 bp, Ctenocephalides felis
tgaatgtatgaatttggaagtctttagaattctgtattgggaaatcttcgcgataccatttaatcgtaggtaaaggatcgccatcaaattccacttcaaaacgagcttgttcttgttcaaaagctctgcaaggttgaattttctttgtgaaaaatggagctttagatggttttacaggaccttgaacaactctttcaaatgttttgcccttgtgttcaacttctgtcgtttcggtcgcagtaatcttgcgggttatttctaaatctcccactgtttccttttgtgtttgcttttgtttggcaacatgaacttcttttccatgcactgttgattctgaaggttcaggtgggtgacctgggacatgttgagaatctattatatattctgttgtatgtggcttttggatatattttgctttaggaggagcatcaacagctgtctcagtagtttgt

SEQ ID NO: 44 - DNA, 498 bp, Ctenocephalides felis
tgcatctagttccagtcacatgttgatatttggttcttgcaagcattgaatgcattgcatgtcccatttcatgaaaaagattatctaccatagctgggcttaaaagcgtggggcttgaccatcgcggtggtgccaaatttaatacaactactactataggattctgatatgaaccatcggatttctgtttaccaccttgtatggtaaaatggcaatcttgatttggctttcctggtctttcataaaaatcacaatatatatgacctagagttccttcagtctcatgaacaatttttaatttatatatatcattagcccaagcttcaccaggtgccatttcttcaattacaaatttaataccaaataaagattgcattaatatgtccaatccttccatacaaccaccaaggctaaaataaggagcaaactcagatgctccaacttgtaaccattgcttcctgattttttgtgtaagtaaggtgtatcccaagcagctaa

SEQ ID NO: 45 - DNA, 498 bp, Ctenocephalides felis
  misc_feature (488)..(488): n = unknown at position 488
caaccgaggctcaagttaaagcactgtcaaaggaatgggctaaccgtgccacattaccagctcatgtagtcagtttattaaataatatgcctagcaaccttcaccctatgtcacagttatcatgtgccgtcacagcattaaacagtgagagcaaatttgcaaaagcctacagtgaaggagtcaacaaagctaaatactgggagtatgtatttgaagacagtatgaacttaattgctaaactgcctgtagtagcagcaacaatataccgcaacacatacagggatagtaaaggaattagtgccattgatacaaacaaagattggtctgctaatttcacaaaaatgttgggttatgaggatgaaaaattcactgaattaatgcgtctatacctcaccattcacagtgatcacgaaggtggcaatgtatcagcgcatacagttcatttagtaggatcagccctcagcgatcctacctctcatttgctgcangtatgaacgg

SEQ ID NO: 46 - DNA, 500 bp, Ctenocephalides felis
tttttttttttttttttttttttttttttattattgaaattcatttattgaatataattaaaatttcacatatttatattcataattttactacatttctaagccttcattataatacccgttgcctgcagctccactagttttacttgcattagaattaatattgtttggataatcgtcatttttaatacttgtatttgtattagttaaatttttggcccatggctgcacttcgccggatgcaaaaaaccaatatatcacagctcctaacaaatatattccacttgaaatgtaaaatacaatttgccacgatgtgagtaaatcatctccaacctttccattaacaatgaaaccagtcaattgagggctgattattcctggcaatgttgcaaaagtatttgacaatcccatcagaacgctagcatattgtggtgcgatgtccaaatgatttacactgaatccagaccaagcaaaagcgcccaaacccacagcgactgcag

SEQ ID NO: 47 - DNA, 498 bp, Ctenocephalides felis
attgccttattatcaatgcttttgtctaagttcttgatgaacacattgcctacacctgacttacgcaaagaggatctctttgagaccacataatgcgaataggtctgcccttgagcatatcgaagttcatggtgtctatggctcgctcggcatcggcaggctgctggaaattaacgtaggcgtagcccaaggagcgcctcgtgatcatgtctcggcatacccttatcgacaatacgggccccgcagtcgaaaacttctcaaacaacatcgcctcggtgatgtcggaatgcagatctccaacataaagggacgccatcgggtagttaggagcccctggattcatatcttacggcctttatatacttaaaccacgaacaaattaattattaataagaattgattaaaaatatctatatttccaacgtggcgtatatctcctcaaaatggctcgtctgtcagtcaaaccacgttgaatgcgcgcactagtttcaacatttg

SEQ ID NO: 48 - DNA, 375 bp, Ctenocephalides felis
tttcagaagagaacttgcgtggtgttagattcaacatttatgatgtcacacttcatgctgatgctatccacagaggaggtggccaaatcattcccacaacacgtcgttgcttgtatgcttgcttaataacagctgcaccaagattgatggaacctgtatatcaatgtgaaattcagtgtcctgaagttgctgttggtggtatctatggtgtgtggaactggtatagttatttgacgctccttctcgaaaacatacaaaacagccatgggaaaggaaaaggttcatattaacatcgtcgtcattggacacgtagattcaggtaaatccaccacaactggacacttgatctacaaatgcggcggtatcgacaagcgt

SEQ ID NO: 49 - DNA, 168 bp, Ctenocephalides felis
caaacggtgtgaactccttgcgcagcctttcatcatcgattgtgtcatcaaggttcttgacatacaggttaacaccttggtagcgattcagacgttctattttcagctgctcaaacttacgcttgagttcttgttggcgttcagctttcttttgagcacggccaacgt

SEQ ID NO: 50 - DNA, 498 bp, Ctenocephalides felis
attttcctttaactttaatgagaatggtcatatcagtaagatctttaccatcccatttatcaaatggttccaacaattgcaatcggtctgatttaggatcaacattaactttcacacttgagccatctgcaggaggttgttcatatgtatcttgacctgcatcgaaacctttgcttggaagttcatcgccaaagggtgaatcaagtttgaattctttgccatcgcttcctttcagagtatctgttactggattaaaatctaagcggccagcaattgatagagctgtgactaattcaggacttgtgacaaaacagtgagtggcaggattagcatcattacggcctgtgaaatttctattatatgaagtaacaattgtgtttttctctcctttcttcacatccttacgatcccactgaccgatgcaaggtccacaggcattgctaaaacagtgcccccaaaattcacgggagaagtttgggcaattccatctcgttcgat

SEQ ID NO: 51 - DNA, 498 bp, Ctenocephalides felis
aatcaataagaatattggggccagttccatcaggaccaaagcaccagattttacgagcttcagttacatcataatcatactgttcaccaagataacgagcacgagctttgaattcatcacgggggttgacttttccactgtcgatgtcttctgcgaggccatcaggcataggttgtgccttcatgaataatctgttgtgcttgtttggagatttagacaagcacatttggtctgattcttcagatacagtttccctgtaagatacaacagggtcagatttctttaatggaatgcaagcatggtcttcttccaaatctttcaagcaaatttccaagtgcaattcaccggcaccagcaataatgtgttcaccagattcttcaatgatacattggaccataggatctgatttggccaggcgtttcaaaccttctaccaattttggcaagatcagcagggttcttaggttcaacagcaacacgcacaacaggagaaactgag

SEQ ID NO: 52 - DNA, 310 bp, Ctenocephalides felis
cggcgcgacgatacgcgtggagtcttcgcgggggccggagtttatgatgacggttaccaagatctgtaatggattttctccagtaagcaaatgaatgatttcaaaagcgtgcttgacaatacggatggccatcagttttttgccattgttacgtccgtgcatcatcagggagttggtcagacgttctacgatggggcactgggctttgcggaaacgcttggcagcgtatctaccagcagagtggggtagatatttggcgttcttttctttgacggcgatgtaatcctgtagtgacatatcagagacttgt

SEQ ID NO: 53 - DNA, 325 bp, Ctenocephalides felis
aatcacagcaggaagcaaatgacgacagggagtgccataaagatggatggaacttcttcaacacagatattgttttcgacagaaatggagcagttgtggccagatatcgaaaattcaacctttttagtgaaaaacaattcaataccactaaatttcccgaacattcgacatttgtcacagatttcaatgtaacgttcgggctgttcacctgtttcgacataatgttcaacgaaccagccttggccatggtgagagaaggcgttagagactttgcattcccaactatgtggtttagcgaattgccattcttaacagctcgtcaagt

SEQ ID NO: 54 - DNA, 623 bp, Ctenocephalides felis
  misc_feature (581)..(581): n = unknown at position 581
caactaataaaacaagatcggcttcttcagctcttgcaatagaattattcagtatataatttgatctcaaatctgtgccggcaccttctgatggaaatgattgttcagtgtataaattttccgatcctattttattgaacaagtctttgagtgataccaatgcctctgcatcagcaagaccaccagcgactgcagcaatctggcatggctccacaccttgcaaggctttacatacagcaataagtgctgattcccaatcaacaacttctaattgtgatcctgatttccttaacatgggtgtgactaatctttgtcgtttaagaccatcaatagcaaatctagatttatcggataaccattcttcattaatttcctcattagttcttggtaaaactcgtaaaacttccccagatcttgagctaacaacaatattgctccctatagcatctaaaatatcaatagaatcgatccggcgagtttcccaagagtgaaaagtaaacgctgtaggtttcgacgttaaagcaccaacaggacacaagtcaataacattaccagataattcaagtcataaaaaggttttncacatatgtgccaacttgcatgtcgtttccacgacctgtagt

SEQ ID NO: 55 - DNA, 527 bp, Ctenocephalides felis
  misc_feature (528)..(528): n = unknown at position 528
  misc_feature (540)..(540): n = unknown at position 540
  misc_feature (556)..(556): n = unknown at position 556
  misc_feature (595)..(595): n = unknown at position 595
  misc_feature (615)..(615): n = unknown at position 615
  misc_feature (631)..(631): n = unknown at position 631
  misc_feature (658)..(658): n = unknown at position 658
  misc_feature (672)..(672): n = unknown at position 672
  misc_feature (688)..(688): n = unknown at position 688
  misc_feature (698)..(698): n = unknown at position 698
  misc_feature (702)..(702): n = unknown at position 702
  misc_feature (705)..(705): n = unknown at position 705
  misc_feature (707)..(707): n = unknown at position 707
  misc_feature (711)..(711): n = unknown at position 711
  misc_feature (744)..(744): n = unknown at position 744
ttaattttaataaaagtgcatgcgaaaatctagccgcaatgtctggaatgttgacgatttcatcgcggaccattccgcgaaaagttttacgacttgcgacagatctcgtagaggcaaataattcaaaggttctgaaagcagccttaagtactaaagcctcacacaaacaatgcgttctaagactagccaaaccagaggtatataacatacctagaacaaaggtgttaatgaagtggcctcaacataatcgattagtgcactcttctgcagctttttatgcatcaaaagtagttaatgtacctccatttgcagattctgtatcagaaggcgatgtcaagttggacaaaaaggtaggtgactatgtgtctgtcgatgaagtggttatggaaattgagactgacaaaacatccatgcctgttccggcaccagaaggtggtgttattgaagaaatcttagttaaagatggtgacactgtcaaagctggacaggctttgttcaaactgaacacttcagctgcaccaccagca

SEQ ID NO: 56 - DNA, 478 bp, Ctenocephalides felis
  misc_feature (5)..(5): n = unknown
  misc_feature (37)..(37): n = unknown
  misc_feature (41)..(41): n = unknown
  misc_feature (206)..(206): n = unknown
  misc_feature (248)..(248): n = unknown
  misc_feature (279)..(279): n = unknown
  misc_feature (298)..(298): n = unknown
  misc_feature (306)..(306): n = unknown
  misc_feature (346)..(346): n = unknown
  misc_feature (352)..(352): n = unknown
  misc_feature (356)..(356): n = unknown
  misc_feature (364)..(364): n = unknown
  misc_feature (371)..(371): n = unknown
  misc_feature (386)..(386): n = unknown
  misc_feature (401)..(401): n = unknown
  misc_feature (409)..(409): n = unknown
  misc_feature (431)..(431): n = unknown
  misc_feature (448)..(448): n = unknown
tgaangccctttagtgcgctcggaattcggcttcgancggncgcccgggcaggaccatttgcaagaattatcagtgtaatccaaaaacaatcctgtccgcacgcaagcaaagggttgcgatggtcctggtcctggtggcggtggtggaggtgcagctgtcgccaagcactcggataaaggcgcttgcacgcattgatggtaaagcncgctgaagtatgtctgtccggcgcatgtaaagcgacccacgntgaaatttcctccagagagtctcacacattnaaaatatactttgcatgtnctgtctgntggatctgcaaatgagccgctctgcacgcagttgtatatnggcggnggcntatgtggntgccaangcgctggaggatttnttaggcactccgaangggaaacnaccacacattgctgataccgtnctgcttaagtaagtagnaccaggacaattgtgcgcgctacactgaat

SEQ ID NO: 57 - DNA, 498 bp, Ctenocephalides felis
  misc_feature (496)..(496): n = unknown at 496
acacatgatctaatcatccttctttgaatctgtctttccaccacgtattctaccagtacgtcttgcagcaataagaccaatcttacgaccagcagatgttcctctcttaacagtagatgctttaccaatatgttgatggttaccacctccgtgaggatgctcaacagggttcatagcaacaccacgaaccttaggccagcagttcctcttaaccttgtatttgtggtatgctctaccagctttcaaaataggtttgtcaatacgtccaccaccagacacaataccaaccatagcacgattgttagaaggcataacctttttagctccagatggaagcttgacacgagtctttttagtgtccgggttgtgagcaataacagtagcgtagtttccagaagcacgggctagccgacctcggtcaccagttttctcctctaagttgcatacaatggttccttctggcatagcaccaactggcattacatttcctatttgnag

SEQ ID NO: 58 - DNA, 190 bp, Ctenocephalides felis
acgtttgggcaatgggaacctgattttcgcatcgtggaattgtgtaacttgagggcgtctacaattagcagctttcacttcttccactttgattacttgaatagagtgagcacgagccctgtggcgtgcacccatgtcacgatagcactgagtgacggcacctccgacagttaagtctctgtattccctg

SEQ ID NO: 59 - DNA, 393 bp, Ctenocephalides felis
  misc_feature (61)..(61): n = unknown at 61
  misc_feature (69)..(69): n = unknown at 69
tctccaatatcaaagcaggctacagacagaacaaggggatcacgagagctttcaagtaagnggatcaanatacgcaataactcataattcttctcattgagacgtggggcattctctctccagaacttagcagatttgtgaacaggtgaccattccaatctgccggacttgatttctgtagcatattcatcaaatgagctaaggtcttgaatggaagcttgtaatttttcggtcaaatattcaacatcagcaacgatatcctcatcatctgaacgtctttgttccaggatggataattgtttcaataccttgctttgcaccattgcaatgcaatgctccttggccacctgttgatcttccactttctcaattaaattcctataaacagccagt

SEQ ID NO: 60 - DNA, 307 bp, Ctenocephalides felis
  misc_feature (62)..(62): n = unknown at 62
tggcgacacctgactactctcacaccggtgagctacaaacgctcaacatgaagctaagaaanactctagagttatatgccaatgttgttcatgttaaaagtttgccaggagttcgctctaggcataagaatattgactgtgtaatcattcgtgaacaaactgagggagagtatagtgctttggagcacgaaagcgttacaggagttgtagaatgtttaaaaattataacagctaagaaatctgaaaggattgccaaattcgcttttgactatgcaacaaagcacaatcgaaagaaggtgactgctgt

SEQ ID NO: 61 - DNA, 229 bp, Ctenocephalides felis
gaaaggccgtgatctttttgccatttttgatcaattggacacggacacacttgcggatggcagagttgggctgtttggcttctacgccaactttctccaaaacgattcccttagcgtgagaagcacctccgaaaggattggccttccacctggttcctaaatgagcctttttgtagtctttgtcggcccacctttggtcacgacgatggttaacatgttttctagcagt

SEQ ID NO: 62 - DNA, 326 bp, Ctenocephalides felis
  misc_feature (194)..(194): n = unknown at 194
  misc_feature (248)..(248): n = unknown at 248
  misc_feature (279)..(279): n = unknown at 279
  misc_feature (327)..(327): n = unknown at 327
  misc_feature (347)..(347): n = unknown at 347
  misc_feature (362)..(362): n = unknown at 362
  misc_feature (369)..(369): n = unknown at 369
  misc_feature (374)..(374): n = unknown at 374
  misc_feature (381)..(381): n = unknown at 381
  misc_feature (397)..(397): n = unknown at 397
  misc_feature (400)..(400): n = unknown at 400
  misc_feature (426)..(426): n = unknown at 426
  misc_feature (432)..(432): n = unknown at 432
atcactagctcatcatgttatagctgcttggtttttaaaatgcaggctgcctttcaggagagattttgtaaaatttatcaccacggtatgtgtgaaatataacaattgtgttaacttggtagtaaacaaaatatattaatcaattcatgacgtatagggcctaaaatcaaattgcattgcaccatttgaggaangaaggatattaattaaaccagaggttacaactttgaatgaagaatcatcttacngaaaaagaaagtctaggttaacagaaccagntaggtatttggaggttttcataagaaaaatgggtgaaatggtaaatg

SEQ ID NO: 63 - DNA, 525 bp, Ctenocephalides felis
  misc_feature (5)..(5): n = unknown at position 5
  misc_feature (15)..(16): n = unknown at positions 15 and 16
  misc_feature (20)..(20): n = unknown at position 20
  misc_feature (24)..(24): n = unknown at position 24
  misc_feature (29)..(29): n = unknown at position 29
  misc_feature (31)..(31): n = unknown at position 31
  misc_feature (43)..(43): n = unknown at position 43
  misc_feature (48)..(48): n = unknown at position 48
  misc_feature (55)..(55): n = unknown at position 55
  misc_feature (127)..(127): n = unknown at position 127
tgggnactattggtnngctntttntaaancnccccgcctttcnggtanatcctcncagtgggccagttagacataacgtggccacatatacctacagcatcccattcaatgttagatagacctgatncatcggagtaagtagcctgcgaaagcaaatgctgtaaggcgtgtccaaatttgttgaataaaattgatacctcttttagagacagaagagaaggtatattgccctcaggaggatttagacttaaaattaatgatgctaatggtgttgtatccacaattttacttttattgcgcatactcaacatccatcctgaactcttttggaatatcttctcttcttctctagtataaggatctaaataaaatccagccagtggcaattcagctgcagaatcatgtatatcaaaataccttacatctttatgccaagtattcatatttgacctttcgataattttaataccatacaacttttcacacaactgaaatagcccgttcaaaacctttggaaatgggaag

SEQ ID NO: 64 - DNA, 164 bp, Ctenocephalides felis
gaaacaacagctgctgggttgtaaccgatcttcttgatgtatgaggatacttccttcttgatttcctcgaaacggttctcgctgtatggtggctcagtggagtccatcttgttgacaccaacgatcagttgttttacaccgagggtgaaagccaacaaggcgtg

SEQ ID NO: 65 - DNA, 490 bp, Ctenocephalides felis
  misc_feature (4)..(4): n = unknown at position 4
  misc_feature (12)..(12): n = unknown at position 12
  misc_feature (19)..(19): n = unknown at position 19
  misc_feature (22)..(22): n = unknown at position 22
  misc_feature (41)..(41): n = unknown at position 41
  misc_feature (74)..(74): n = unknown at position 74
  misc_feature (82)..(82): n = unknown at position 82
  misc_feature (107)..(107): n = unknown at position 107
  misc_feature (216)..(216): n = unknown at position 216
  misc_feature (252)..(252): n = unknown at position 252
  misc_feature (298)..(298): n = unknown at position 298
  misc_feature (450)..(450): n = unknown at position 450
ctgncagtccancaccctntgncaatttaaacattagctgnaatcttccagtggctcctaagtcaattccagancgatctanttcatctgtgtcaagtgaggattgnccagtttgtaaatctagcctctcagtaacatttccaactttcataggtcgaccagccaattcaaatccatttaactgctctaatgcttttttagcatcatcgtgattgngaaacgttaaaaagccatatcccttagaccgccggnttccggatccattatcaattgtatgctgtcaatttttccaaaaggntcaaatattcctcttaacatatcttcagttatattgaaatgtaacgaaccaacatataatctcatgggaccagtatggcctttggtgctaaattgggcattgaattacccatgcgatttttttcagcctgtgtgcgctgaactacaatcggnattcctaataacttttgcctggtagacctaaaggcaatgg

SEQ ID NO: 66 - DNA, 97 bp, Ctenocephalides felis
ttctcatgatgggtcgttatgtagaactattgaagatgttccttctggtaacatttgcggtttggtcggtgttgatcagttcttagtcaagacaggt

SEQ ID NO: 67 - DNA, 533 bp, Ctenocephalides felis
  misc_feature (30)..(30): n = unknown at position 30
  misc_feature (73)..(73): n = unknown at position 73
ctggctaacacattatttagaaattactgnaattccgagaactcatgtcttaaaagaacttgctgaatactgntctgatgaaaaagaaaaagaacaattaaaattaatgagctcaactgctccagaaggaaaacaattgtatcaagattgggttgttgaccagaaccgcaatattgtgcatattttggaagatctgccatcatgtcgtcctccaattgatcatctgtgtgaattgttacctcgcttacaaccacgttattactcaatttcaagtagtgctaagctgtttcctaccacagttcatatcactgctgttctagtgaagtataaaactccaactggtagaatcaacaaaggtgttgcaacatcttggctggccaagttcaaccccagtcctgagaaacctcaagttgtgcctatatttattagaaaaagtcaattcagactgccaaccaggtctcagactccaattattatgggtggcctggccaaatctctttcttgtataaatcctctgaaaggagccaaacctg

SEQ ID NO: 68 - DNA, 439 bp, Ctenocephalides felis
tcgtggggtagttcttgggaaaatttcttggcttccctgtgatacatttcctgagcccgtgaacacgaacgtcaatggacctacagattttggcatcatacctaaagcgatttcatatccagcatcccttatggattgtctggccatggaggaatttctgtaattgtgagccaatccaatatgcatgaaaggtgtatgatgacccaaagctaaaagacgtaaacctaatccgtgcaaaatattgatcataccggcaacaccagcatattttccaaatgctactactctttggcccttttcgtccatcaacttttcataatcgataagacgaatattcttttccataattgcatcaagtaaaggcatattagattcttgggctttgataacatgtgaaaacatgcagtaggttttattgggaattaattgttctacaggt

SEQ ID NO: 69 - DNA, 268 bp, Ctenocephalides felis
ccacaggaaaggaggtagctatcaaaattattgacaaaacacagctcaatcctggttcgcttcaaaaacttttccgagaggtgcgcatcatgaaaatgttggatcacccaaatattgtaaaactgtttcaagtgattgagacagaaaaaactttatatctagtaatggaatatgcatcaggtggtgaagtgtttgattatcttgttcttcatggtaggatgaaagaaaaggaagctagagccaaatttaggcaaattgttagcgctgt

SEQ ID NO: 70 - DNA, 145 bp, Ctenocephalides felis
  misc_feature (49)..(49): n = unknown at position 49
  misc_feature (71)..(71): n = unknown at position 71
ctctcgtcgctaactctcaattcctgggtgacttgctcgtagtctccgntcaaagtcgataattcctgctngattttgctctttgagcttgccaaattgacgttgattaccgtcaactcgttgatgcgggcgacgctctcctcgt

SEQ ID NO: 71 - DNA, 327 bp, Ctenocephalides felis
  misc_feature (207)..(207): n = unknown at position 207
  misc_feature (227)..(227): n = unknown at position 227
  misc_feature (304)..(304): n = unknown at position 304
gagtgcacagaaaattctctaccttgagaaagtttatggaaaaattagagaattgtaactatgctgttgatcttggaaaacagatcaagttctcactagttggtattgctggacaggacatcaagtgaaggaaatgctactttaactttagcgcccatatggcagcttgatgagagcttatactttatctgtgttgacacgtttggnaaacactggaagtccaatanttgaaagagaaattgttcagtgggtgaataccaagctagcaggtgccaataaaacaacatctttgagtagctttccnaggacaaaacaatttcagatgct

SEQ ID NO: 72 - DNA, 304 bp, Ctenocephalides felis
cattgtggatgaggcaaatcccatataccatgatgaagtttgcttgtttcgaaagaacagttgaattgttatacactcatgtggttcccaaacccagagcagaatgcactaaaggtgaacaattggttgtcacctttgctgctggttacattgccggtgtattctgtgcagtagtttctcatcctgcagacacagttgtttccaagctaaatcaagacaaaggagcaacagccattgacgctgcaaaaaacttggctttgctggtttatggaagggattaggacctaggatcatcatgattggt

SEQ ID NO: 73 - DNA, 232 bp, Ctenocephalides felis
caaagtgatttaccagagaagtttgtgaaagacttgggtgtcctcaacgctttatcagacaaagtcttggaattaacccccgatgaacgccctacctgttcttcttccgcttatcaacaaatttcaaatcccccgaagacaccgacaaagccaaaacagagctcaccaaagccatcaaaaccttgagcgaggcttttgataaaacctacaaaggcaaagtgctgttcacagt

SEQ ID NO: 74 - DNA, 339 bp, Ctenocephalides felis
  misc_feature (108)..(108): n = unknown at position 108
  misc_feature (284)..(284): n = unknown at position 284
gtaacccgattctacacgagttggttttaaaactaagctcggatgacgtttatgttaatcaataagtatgcagaagaatatgttttcttaaaacattggacaggaacncacgaagaagatcaagtccaaataaagaaacgtcgtgaagtcttggagcgtttttgcaaacttattgaatttggtatcataccagttaccagcgcgtcctttgttttgatgtattatgtgaagtgtgaaaaatgctatggagatatcataaagaaaatggttgccacgatgtgcancctcagcaggacaaattgcaccatggtcatgttcctgagtttggcgaaaatttat

SEQ ID NO: 75 - DNA, 339 bp, Ctenocephalides felis; identical to SEQ ID NO: 74
  misc_feature (108)..(108): n = unknown at position 108
  misc_feature (284)..(284): n = unknown at position 284

SEQ ID NO: 76 - DNA, 188 bp, Ctenocephalides felis
  misc_feature (39)..(39): n = unknown at position 39
  misc_feature (61)..(61): n = unknown at position 61
  misc_feature (182)..(182): n = unknown at position 182
cccagaagtatctgctttggagcacgatttattgaagtngatccagaaactaaagaaatgntgagcatgctagatttcaagaacatcagtggtctgcaattaactcaaccccaaacattcaatgctaggcgttaatatgaaaatgtcagttatattcttataaataaatatatataactggnaaataa

SEQ ID NO: 77 - DNA, 468 bp, Ctenocephalides felis
  misc_feature (436)..(436): n = unknown at position 436
  misc_feature (442)..(442): n = unknown at position 442
ccacagaattaaggtggtttcaaggcccaagacttgcagaacactttcatgatcaaagaattgtcccagtatatttagatatggaggttgaacatccactattcactgaaactattgatatgtgcttatctgtttatccacctgatgccggacctccacatgtaaagcttcagttagaatggtctatgaaagaatatgaagaaattattcaacatccaggggatgttttagaagatcattttagtgtgtctgaagtgctgccaaaagtgaaaatgcaaatcctctaactttagagcagtgcttagaacattataccagagcagagactctctctgatgaagatgcctggaggtgtccacattgcaaaagtatatgccggttgttaagactttgggcttgtggcattacctgatatactagtaatacattttaaganggtcangcagcaccaaattaaggcaatagaag

SEQ ID NO: 78 - DNA, 382 bp, Ctenocephalides felis
  misc_feature (13)..(13): n = unknown at position 13
  misc_feature (67)..(67): n = unknown at position 67
ttaagtctggatncacccaataacaatggtgggtggaaacgcccatagaattcatccaattccgggnagtttttttcttcgcggggtctcttcacaggtctctaatccctctatttcgccttctggacgatctaatcctggatgggtgttgaacaagttggctacgaacgctaaattcaacttataaacgccattaacaacatctgctgctgttacaaagcttctgcatttgagtttagcagcttgttgcagcatgatctcagctctctttgtcatatcttgttccatgagagcttcgttcgtaacttgagcttctggaggtgcaatttgtttcaacagaatagtataaacctctgaatccgaaatgtcgacttggaagtta

SEQ ID NO: 79 - DNA, 141 bp, Ctenocephalides felis
  misc_feature (55)..(55): n = unknown at position 55
gtttgtgcttgcacatataaatattaaaaatgtctaaaagaggacctggtggttnagccggagctaaattccgcatctccttgggtctgcctgtcggagctgttattaattgtgccgataacactggggccaagaacttgt

SEQ ID NO: 80 - DNA, 247 bp, Ctenocephalides felis
gttgacccataatcggtttgtagttaacacatcttctacttcatctaaacgctcagcaaactttgaagcaaattcgtaaatatcatccatcaatccaattgggcatatcctgtgacacaccaccaggacgaatataagcagcatgcattctagcgcctgatactctttcatagaattccatcattttttctctttcctcaaaaagccagaaaaagggtgtcaaagctcctacatccaatgcatgtgt

SEQ ID NO: 81 - DNA, 498 bp, Ctenocephalides felis
  misc_feature (11)..(11): n = unknown at position 11
  misc_feature (28)..(28): n = unknown at position 28
  misc_feature (31)..(31): n = unknown at position 31
  misc_feature (72)..(72): n = unknown at position 72
  misc_feature (74)..(74): n = unknown at position 74
  misc_feature (105)..(105): n = unknown at position 105
  misc_feature (128)..(128): n = unknown at position 128
  misc_feature (170)..(170): n = unknown at position 170
  misc_feature (424)..(424): n = unknown at position 424
  misc_feature (457)..(457): n = unknown at position 457
  misc_feature (490)..(490): n = unknown at position 490
aatttctccgntaattggtggagcctgntgntcttcttgagtagagatttcagtaagagaattacagtttgngntgccggaagccaattgcgcttttaataaagnattttggtcttttaattgattgntacttatcactacttcctctagctgactctggattgcattgntttgattggataactgctgagcttgcatgcgcaattgcatcatctgcatatcttgctctcgaataatatttttatatttgcacaataaagcagactcttgttcagataacgacatttcagataaattcaaattattggttccatctccaaatgatgttattgtcttgacaataagtgcctctagagctttgaatagttcacaaaattcataatcaagtaacagctctctatacttagtagcttttatagcaggntgctttgcagctaaactatacatctcgtgccgngagaattttgatagctttgcaacaaacgtctcnctccaatt

SEQ ID NO: 82 - DNA, 353 bp, Ctenocephalides felis
agtatactttgacaaaatataaatgccaatatgcagtcgaagaataggcgttcttgctgtcttgcacaaatctccagacatattgtgggatgttcaaaattactttttagaagcagcaccaactttagattttttcgttcctcggactttcttcattctgttcttacgttctttacgttgtttacgtgtctgttgcttcttttcatagagaccgtgccttcctaacctgtgtttaggttcaaatttcttggcatagtctaatgagtcgtagattaaagcaaatccagttgatttgccaccaccaaagtttgtgcggaagccgaatacaaatactacatctgatgtaactttgt

SEQ ID NO: 83 - DNA, 498 bp, Ctenocephalides felis
  misc_feature (205)..(205): n = unknown at position 205
ccaaatattgcagttcctacacgaacaatattgctgcccatttcaatcgcttgttcaaagtcgtcagacattcccatagataaattaacttcttttggttctaaatttaattccttgcataattgctcacgacattgttttaaagtgagaaaatctgggttgggtcctaaacttgtatcatagccatattttccaatagtcattnaaccatcaacaagtaggtttgggcaattttctttcacatatttgtatagagttgttgcctcatttgggtgaacaccatgtttttctatttcaccacttgtatttatttgaatcataactcttaatttatcaccatgaattttattagctgaatctaattttgaccaagcattctgcacactgcggctaatttaaatgagtgaattgtttcgaccatatatatcccaggtatgttaaccaccttattaattttatttctttgaagatgacctataaaatgccatttatttcttt

SEQ ID NO: 84 - DNA, 268 bp, Ctenocephalides felis
  misc_feature (4)..(4): n = unknown at position 4
  misc_feature (35)..(35): n = unknown at position 35
  misc_feature (156)..(156): n = unknown at position 156
  misc_feature (181)..(181): n = unknown at position 181
  misc_feature (233)..(233): n = unknown at position 233
ttgnttccactttggccccaacagtgaggaaaggngtgtattatttaagtatagcagctgcaggatttttggtattcataattgcattaacaattatacgtttaataatattctgtataatttggatcataacacttggtaaacatcatttatggntatttccaaatttaacaaaagaagntggggtctttgcatcattttggcctctatataagtatgaatataaaggaggngaagcattagaaaatactagcaaaaaaaaaaaaaa

SEQ ID NO: 85 - DNA, 223 bp, Ctenocephalides felis
  misc_feature (19)..(19): n = unknown at position 19
aggttcaacaccaactgtngagtatccaaccaatcttgccaaaggttttaagccatgctgtttgcaggattcttctgatgctaaaacaatcgctgctgctccatccgatattccggaagcagatccagctgtgacaacgccatctttcttgaaaattgtaggtaatttggataaactttctagagttgtttgtggtcttggatgttcatctacacagaattgt

SEQ ID NO: 86 - DNA, 252 bp, Ctenocephalides felis
attgccttctttatctagtcgggttttcattcttgcgataaaatcgttggcaatttcttcaatccatccaacatattgccttgtaatcttatgctgcatcatgggctgatttactactgaccgaattttttgccattcttccccttgtgagtgaattagaccataaacagatttgaaaacttctggtcttttttctctcaagtaatattctcgtgattcaaaagctggtctatcaggccaaggcccttcagt

SEQ ID NO: 87 - DNA, 235 bp, Ctenocephalides felis
aatccagggagaccatcagacttgaagattttggtcaagcagttgcccaatccagagaattcacgttgaccagcgcctttacctacatcagcggccaatctggtacgggcgaaatcaagtgggtagacgaagcacaatgatgtggctccagcagcaccaccagatgccaagtttcctgcgaagtaacgccagaattgggtcttcttgtcaactccacccaagaaaacttgcttgt

SEQ ID NO: 88 - DNA, 498 bp, Ctenocephalides felis
  misc_feature (59)..(59): n = unknown at position 59
  misc_feature (365)..(365): n = unknown at position 365
  misc_feature (404)..(404): n = unknown at position 404
  misc_feature (456)..(456): n = unknown at position 456
ataaagtatccgttcaatggtaacgtttcagcagcaaaccaataattagtaacatctanaaaaggagctgataatgacaaagctgctaaaaaacaggtatgtcttaaagcaactcttctacataatgcaggatcagtaactgccatcattctatacccagctctactgtaatccggtcttaaattccaagataatgcattaaaatgtggaaattgccacgtatataaaagacctcctaagataaatgctcctgcacttaaattaccggaacaagcagcccaacccattaggggtgggattgctccgacgattgatccaacccaagtattcagaatacttattcttttcattggagtatatacggnggtatataatattaaattagctgctcctaatcctgctgntaaaccatttacaccaaaatatacatacctatcccgtagatgcagcaaccgnagcaaaacctacagcatgtatggacttaaaatcccctgacta

SEQ ID NO: 89 - DNA, 293 bp, Ctenocephalides felis
  misc_feature (24)..(24): n = unknown at position 24
  misc_feature (50)..(50): n = unknown at position 50
  misc_feature (92)..(92): n = unknown at position 92
  misc_feature (282)..(282): n = unknown at position 282
tttttttttttttttttttttttngcacattatattaatataatcacttnggcctttttagacttgatcttcctcatgtagaattccaattnttttccttctaagatataaccatctgcacgtccacattgtccaggacgagaggaaacagcagctaatagacgaccagtagcaaactgttcttccagagcttgctcaactttagcaacacgttgtcttgttgcatattttttagccaccttcttactgcgttttttattcataactgcttcttcttcaggngtgagcttagt

SEQ ID NO: 90 - DNA, 498 bp, Ctenocephalides felis
  misc_feature (28)..(28): n = unknown at position 28
  misc_feature (66)..(66): n = unknown at position 66
  misc_feature (73)..(73): n = unknown at position 73
cattcatgcaaatggggcatcatttttntttatttgtatttacattcatattggacgaggaatggnattattntagttacaaattacatgaaacttgatttattgggttattaattttatttttagtaataggaactgcttttataggatatgtattaccttgaggacaaatatcattttgaggagcaactgttattacaaacttaatttctgctattctatatattggaaattcaattgttcaatgattatgaggaggatttgcagttgataatgctactttaactcgattctttatgattcattttttattaccatttattatttctgcttttgtaataattcatttgctttttcttcatcaaactggatctaataatcctttaggaattaatagtaatatttacaaaattccttttcatccttatttctctctaaaagatttattaggatttatttttttatttacaatattaattatattaactcttattaatc

SEQ ID NO: 91 - DNA, 339 bp, Ctenocephalides felis
  misc_feature (46)..(46): n = unknown at position 46
  misc_feature (208)..(208): n = unknown at position 208
  misc_feature (223)..(223): n = unknown at position 223
  misc_feature (234)..(234): n = unknown at position 234
  misc_feature (289)..(289): n = unknown at position 289
gggatatattataagatctttattttataataaattatataatcgntatttacttgaaagacaaaatattgaaattatttgaacaattctacctgcatttatattaatttttattgctttaccttctcttcgacttttatatttattagatgattcaaataggcctttaatttctttaaaagcaattggtcatcaatgatattgaagntatgaatatactgantttaataatanttcttttgattcatatataattccatctaatgaattaaatttaaattcatttcgnttattagatggtgataatcgaattatcttacctattaattcacaaattcg

SEQ ID NO: 92 - DNA, 234 bp, Ctenocephalides felis
  misc_feature (49)..(49): n = unknown at position 49
  misc_feature (59)..(59): n = unknown at position 59
  misc_feature (61)..(61): n = unknown at position 61
  misc_feature (68)..(68): n = unknown at position 68
cagtgcaacagcatttaaccatgcttatgctgataccggtctattctgnattcatgccngngcacctncaacacatatacggggggtaacagaagtgctctgcagagaactagttgccatgtctacagttccaggggctcaagaactaaggagagcaaaaacacaacttcaatcaatgttattgatgaatttggaagctcgtcctgtggtatttgaagatataggtagacaagt

SEQ ID NO: 93 - DNA, 434 bp, Ctenocephalides felis
ccaatctttttaaaggtaatggcttatcttctgtgatacctcttgctgtggaaagagaagcaacttgatcacaataaacatcagcacctaattcttccatatcaacttctacatcagattttgctatttttgtggcttcatctacttctttcctaacttgcgtttccatttccttcagttcttcaggtgtagctagttctgatgaaaccattctttcacggaatgaagtgattggatctcttgtctgtcttacttcttgaatttcttctcttgttctgtaactggtgccaggatctgacattgagtgccctgaatatctataagtcatagtttctaaaacaattggaccttttccagttgtgcaatgttcaattgcatattttgatgcttcacgcaccgctaacacatccataccgtcaacccaaattccaggt

SEQ ID NO: 94 - DNA, 347 bp, Ctenocephalides felis
  misc_feature (58)..(58): n = unknown at position 58
  misc_feature (243)..(243): n = unknown at position 243
aatggaaagaggatgtcacagaagcttatcctggcaaagggcaagcgctattccaagnattccagtggctgatgtggttgcaggaagccgaatctactgatgaggatggagaagcttaagtgtggaaataagaaacaaaaaatatgaaaaactctgataaaaaggaattgtaagtttaggtcacccttcatattgaaccaatataaatgcttaacatcttccaataaacgaattatatatggntttaatgaagtcagatgaaaggatgaacagcatattatctagaagaaaaactaaagtatgctcgtcacacttcggaaaatgctaagaatgttttattgactcgt

SEQ ID NO: 95 - DNA, 440 bp, Ctenocephalides felis
  misc_feature (38)..(38): n = unknown at position 38
  misc_feature (129)..(129): n = unknown at position 129
  misc_feature (134)..(134): n = unknown at position 134
  misc_feature (164)..(164): n = unknown at position 164
  misc_feature (188)..(188): n = unknown at position 188
  misc_feature (230)..(230): n = unknown at position 230
  misc_feature (239)..(239): n = unknown at position 239
  misc_feature (289)..(289): n = unknown at position 289
  misc_feature (303)..(303): n = unknown at position 303
  misc_feature (307)..(307): n = unknown at position 307
  misc_feature (349)..(349): n = unknown at position 349
  misc_feature (417)..(417): n = unknown at position417
  misc_feature (419)..(419): n = unknown at position 419
gaaaggaccattaatttataataattattttaatttgngaaaaaaaaaaaaaaaaaaaaagggggggcttgtacaagctttcttttttttttttttttttttggctatatcgaaatttattactcaagnttttntacagctttaaacaattattgatccttatntttgccattgtagtagggcaagtnttgtaaaactaatttccaatcagtgaagtagcaaagggcatntgcaccagntagaccaaaaccagcagacgttcctacccactgttttgcttgctcaatgngtttactcccgagntttntcaaaatactcattttgcttacttaaatcaatgctcctcggnttcaataaataattttaagcgcagaatttagctttgcgctattgtttcaaaaaaaaaaaataaaaaananaaaaaaaaaaaaaaaaaaaaa

SEQ ID NO: 96 - DNA, 498 bp, Ctenocephalides felis
  misc_feature (493)..(493): n = unknown at position 493
tttccttgtgctaattcaattgttcggggatgaagtgccagctctggaaccccttgaacaacttcagaaaccaaatcagcaactctagcctgacttgtctgtgaaccagtttgtccaggtgtgttagcagaactttgaatgataagattttggttggcagcaagactctgtccacacatatttctccgtttatgagatgctaaatcattactttgggcaaaagctctaccacaaaccatacaagcgtagggcttttcacctgtatgtgtcctcatatgtatagctaacttatcagatcgtgcaaatcctctgttacaaacactgcatacaaatggtttttctcctgtatgttttctcatatgcaatgtaagatctgtagttcttggataacctttaccacagattttgcaaaaatttgtcatttgaccagtatgtctccgcatatggacggctaaattacttcttgaactgcaacttttaccacaaacactgnataat

SEQ ID NO: 97 - DNA, 186 bp, Ctenocephalides felis
  misc_feature (30)..(30): n = unknown at position 30
  misc_feature (63)..(63): n = unknown at position 63
accacgaggtgcaggcggaattccagttantttaaaggttcctaaacgattgttatctttggncataaccctttctccttcatagacttgaattgttactgcaggctgattgtctgcatgagtgctgaaggtttgtgttcttttacatggaattcttgcattgcgttcaataatcttagccattgt

SEQ ID NO: 98 - DNA, 270 bp, Ctenocephalides felis
  misc_feature (36)..(36): n = unknown at position 36
  misc_feature (40)..(40): n = unknown at position 40
catattttacaactgtatgagtttggattaaaaatnaatncctatgtataataatatgaaaataactattataattacaacaattatagttttgaataaaaatcagttataaaatcacaaaaactgatttatattttacagcaaaattgcttataattaagcttcttattataattaattttttatttcatttctttgcaagctcatttgataaccaatcgaggccttcatataaaccgtgcccttgtgttgcacatgtagcttgaatgt

SEQ ID NO: 99 - DNA, 279 bp, Ctenocephalides felis
  misc_feature (23)..(24): n = unknown at positions 23 and 24
agattaataaatttaaatatgtnnaacaaattaaactggcaaggaactttgcactatgagcttattgatgtaatgatttttcactggtatcgttatctataagtaaaatgctataattaatcttaaaaggctaaaccggcttcagcataagttgtgaagatcttttcaatagagtttacatatgctgctgttctcaagtccaatcccaaattgaatttcattgctgtcttcacgatagctcttgcagacctttccattgtgtagtccaagccagaatgt

SEQ ID NO: 100 - DNA, 193 bp, Ctenocephalides felis
  misc_feature (31)..(31): n = unknown at position 31
  misc_feature (33)..(33): n = unknown at position 33
  misc_feature (38)..(38): n = unknown at position 38
cgacacgccccaagttaccgacctccagtgntnatgcncaagtttcctggaatcaaacttaatataatctgtgatcttagaactggcaatatccacctgaacagtatcgtttactttgattaaaggatctgggtagcgaatggtgcggccatcatgtgttgtcaagaatggaatatttttgggtcccatttgt

SEQ ID NO: 101 - DNA, 110 bp, Ctenocephalides felis
tcatgaatatcaagagtctactataggtgctgcgtttttaactcaaactgtgtgtctggatgacacaacggttaaatttgaaatttgggatacggctggacaagaaaggt

SEQ ID NO: 102 - DNA, 323 bp, Ctenocephalides felis
  misc_feature (5)..(5): n = unknown at position 5
  misc_feature (16)..(16): n = unknown at position 16
  misc_feature (23)..(23): n = unknown at position 23
  misc_feature (66)..(66): n = unknown at position 66
  misc_feature (75)..(75): n = unknown at position 75
  misc_feature (82)..(82): n = unknown at position 82
  misc_feature (406)..(406): n = unknown at position 406
  misc_feature (436)..(436): n = unknown at position 436
  misc_feature (441)..(441): n = unknown at position 441
  misc_feature (471)..(471): n = unknown at position 471
  misc_feature (499)..(499): n = unknown at position 499
aagcatcaggaggccactctgcaatggctaaaacagtcggtttcccagcagcaattgccaccaggatgattttggatggagaaatccaaaaacgtggagttgttttgccattcagtgaagatattttataggccaattcttagcagattgagagctgagggacttcatgccacagaaaccgttaaagttttgtaagatggaggagaaacactttgttttattatcgtgaattcattaatcgattttgaaaatatgactggctcttttagcattatacatatttttaagctcgctttgatatatcaagacataagtatttactt

SEQ ID NO: 103 - DNA, 462 bp, Ctenocephalides felis
  misc_feature (23)..(23): n = unknown at position 23
  misc_feature (36)..(36): n = unknown at position 36
  misc_feature (426)..(426): n = unknown at position 426
  misc_feature (431)..(431): n = unknown at position 431
  misc_feature (442)..(442): n = unknown at position 442
ttttgatgtcatataaatgccancaattaaaccaantagaccaatagcagaaccaaagatttcaacaatgagaattttgacaaatagtgcagaattggcagcatcagcaagagctgctccagatccaacaataccaacagcgataccgcagaataaattcacaagaccaacagccaaaccagctccaaaaagaacataaccacccatccaatttgcttctttatatcctgctttttcaaaaacagatttgtctgtgtattccgctaacagtcctgacagaacaattgctgtaattaaaccataaatagcaacagcttcacagaaaataactgaaattaagttttttgttttgattctgggcgctttcacaccacctcctacaatggatgtgcctgtggtatgaattccaacaagctgctccaacanctganaatgctacggntaaacaattcctaagggagc

SEQ ID NO: 104 - DNA, 484 bp, Ctenocephalides felis
  misc_feature (16)..(16): n = unknown at position 16
  misc_feature (25)..(25): n = unknown at position 25
  misc_feature (31)..(31): n = unknown at position 31
  misc_feature (39)..(39): n = unknown at position 39
  misc_feature (89)..(89): n = unknown at position 89
  misc_feature (116)..(116): n = unknown at position 116
  misc_feature (287)..(287): n = unknown at position 287
agccgtggaaaacctnacggaaccncaattnctttcggnagcccgcccagggacgactacagggaacaaatgtcgatgaagcccgtttncttattaaggaaagcaaactaaagatngtagcccaagatgatttggatgatgcagctgcattagttgtcagtttatctcattacatatatactttgcggttaatttaatgagatatgcatagtatatattaatctttcttttttttcactgcacatgcaaagctaaatttagccagcagaatgtgttattcaacacangtcgtattgtttagtcgtgtaatgtcaacatgtattgcccattttgattggattccttaatacaggatatcagcaccacttgttaagtttgaaactctaggtaggatatgatcatatttattataatgcacatttattatgttactaatgttcaaaatgattgatgatcgatgattgatatcattgtcagtaatagt

SEQ ID NO: 105 - DNA, 373 bp, Ctenocephalides felis
  misc_feature (55)..(55): n = unknown at position 55
  misc_feature (330)..(330): n = unknown at position 330
gaggctcatcagcgtggtccacttctttggacggcaacacttcgtaaggttcctnggactctaacggatcactgagtccaacctcgtttcgcgcaaatattcgtatcaagtattcgttctgctcctgtaaatccctgatagtaaaattctgaatagaagcctgaacgcgtcctacttccatccacatagttttcttaacatctctaatagctatgttgtaaccctcgatgggagcaccaccgtcggattccggaattccccaacttatcacaatattatttggacctacacttctcatctctaagggggcagttggaggagatggcacanttgcgtgagtttttagagtaacattccttgttactgcgggcgt

SEQ ID NO: 106 - DNA, 231 bp, Ctenocephalides felis
  misc_feature (60)..(60): n = unknown at position 60
  misc_feature (88)..(88): n = unknown at position 88
  misc_feature (119)..(119): n = unknown at position 119
  misc_feature (157)..(157): n = unknown at position 157
  misc_feature (192)..(192): n = unknown at position 192
  misc_feature (232)..(234): n = unknown at positions 232, 233, 234
  misc_feature (263)..(263): n = unknown at position 263
  misc_feature (280)..(280): n = unknown at position 280
  misc_feature (284)..(284): n = unknown at position 284
  misc_feature (342)..(342): n = unknown at position 342
  misc_feature (354)..(354): n = unknown at position 354
tattccttgtctggcacataatattttcggctttgatatccaaatgaatgatattctttnggtgcatatggttaacaccttcacaaanttgtctcatgtaatctatgacttctgcttcngacatacgataaccgtcagcggtgatgcgttcaaacanttcaccaccagataagaattccaaaatgagaaccntttcatcatcatcttcgaatgcatcatgaagattaatca

SEQ ID NO: 107 - DNA, 411 bp, Ctenocephalides felis
  misc_feature (145)..(145): n = unknown at position 145
aaaaaaatgcaagaagaagtgtaggcataatcactttccgcctccctctcgtatcggctaaaaatccccataaatgtgaactgcttataatacctataaaagctatagcgcttaatattcctttttgttttgttgttaattccanatcacattgtgctgaaggaacgacaaaactcattccaagagtttccatcaaaacacatactaatacgcatccactcacgaccagaagaaggtaattgaattttccaaaacctgtgagtgccaacgcatcttcaaactgccttggttttggttctttggaagctattatttgaatccccgtgttactgtccatatttattaatttccaaactacagattcaattaaaccgttttgtttaacagtctaacagtaaaaaaaaaaaaaaa

SEQ ID NO: 108 - DNA, 261 bp, Ctenocephalides felis
tctcggtggaatcgatttctgtagtttcgtcgttaactgacaatattagagccaataaatatttcttagaaacatcaacagcccacgtagtctgtgcaagattggtagttggtatatccgtaatgataatctgaggttgttgctggtttaccgattgttgctggtttatcgattgttgctggtttagcaattgctgctgttgccagagaaatttttgttcctgaactttttggtattgtcgcaactgctgttgatgtaagt

SEQ ID NO: 109 - DNA, 498 bp, Ctenocephalides felis
  misc_feature (33)..(33): n = unknown at position 33
  misc_feature (62)..(62): n = unknown at position 62
atttgtatgtaagaaataattcacatctattcntaatgaagaccaaatagataattgaaaanccacaaaaacaacatccgtaggttcattattttgatcatatttaaatagcatgttgttggtccacaaatcaccatgatttaatacatttatacagccaggacgcattttagttgaagccattgctctttggataattgtatccttcatattatataatttttttgaatatttttgatagccatcccaaattgatgtagcttctgaaagctccaccagcgcttttaacagcaattgattcatcagatggtcttcagattctgtttgtataaaacctaatgtgtaatcatcaactgaatgaggatcctttagctccatgacaatggatgcagcatgcatatgtgcaattttgtccataagtaaagtagaatgtgcaatatctaggcctcttgtcctttttcccattttgtaaccacctattgccaaatccgtcataac

SEQ ID NO: 110 - DNA, 356 bp, Ctenocephalides felis
  misc_feature (142)..(142): n = unknown at position 142
tttttttttttttttttttttttttttcctcttttattagtataataatatctacaatcatctaattatatcaaattaattattaatgatgtccatgaccatgatgatcatctttaggattcattttttcccacgccttctntaatgcgactgttactactgtagcagccagtccccatttgaatcctcggaataaaaagcccatcgttcggctccttcttgttccaaattcttttgtattaaatcgccatacttcatttctcagccatgggtctttaagtcctttacttgcaagagccttttggacttgaactaattcaggggcatcttcaactttgtaaatcctataatctggt

SEQ ID NO: 111 - DNA, 500 bp, Ctenocephalides felis
  misc_feature (498)..(498): n = unknown at position 498
gctcattgagtatccgcgaatgaaactaaatgagctttcaacattggacttaagcaacaatgatttttcaatattaccagaacaactcgacataaatctaatgcccaatttgagacacctttcactaagtggaaatccaattcgcaaaattaaatttgaaaatatcctttccttggaaacgctcgagataaacgatatgtcaagacttacagaaatttcgggactcgaaaacatacatggaagaatatttgtcgaatcaaataaaccttgtgttcatctgagcatttcaaattgtgaattgctggttaaaatacaaaatgatgcttttgaaaatataaatttatgtagtttaaatttgagtcataacgctctgaaagaagtgccgctctcggtgccaaacgacatagaacttgatttacagggaaaccctttgatatgctcttgcagcctacaatggttttagacgatatattaccattttgtataaacatcacccanac

SEQ ID NO: 112 - DNA, 189 bp, Ctenocephalides felis
tcatcgttcaggtcagggtgcttttggaaatatgtgtaggggaggaagaatgtttgcacccaccaaaccttggcgcagatggcatcgcaagatcaatgtgaaccaaaaacgctatgctttggtttccgcaattgctgcttctggtgtgccagctttagttatgtctaaaggacatgttgttgatcaagt

SEQ ID NO: 113 - DNA, 131 bp, Ctenocephalides felis
aacaagtgtctctggtcataaattatgatttgccttccaacagggaaaactatatccacaggattggtcgaggtggacgtttcggtcgtaagggtgttgctataaactttgtcacagatgaggacaagcgt

SEQ ID NO: 114 - DNA, 102 bp, Ctenocephalides felis
attccctgaataagagggaataatcgctctccaagcatctgtttctgttcatgagccggtgctgcggcaagcatggaagcggtgagtggttcttggccttgt

SEQ ID NO: 115 - DNA, 299 bp, Ctenocephalides felis
gcgaaagaacatgtcgtataccgtctgaaagaagtaatgaggactggcaggactcaaaaaatggcccttccagcgaaaaagaagcacatgcttatgatgggcctcccggcatggaacccgatggcgtcatcgaaagtaattgggatgaggtggttgataatttcgatgatatgaatttaaaagatgaattacttcgtggaatctatgcttatggttttgaaaagccttcagcaatccaacagcgagccatcatgccatgcatagtcggtcatgatgttatcgcacaagctcaatctggt

SEQ ID NO: 116 - DNA, 403 bp, Ctenocephalides felis
  misc_feature (60)..(60): n = unknown at position 60
cccggtattgctgaccgcatgcaaaaggttaatcactgccttggccccatccaccatggnagatcaagatcatcgctcccccagaaaggaaatactccgtatggatcggaggatccatcttggcctctctctccaccttccaacagatgtggatctccaaggaagaatacgacgaatccggacccggaattgtccaccgcaagtgcttctaagcgctttctaccctctagcaaacaccaaagaaagtgccgtccggaagaaatggcggttaagaaattatgcgcggcccatcgcgctttgcgcatcgtaattgcgcttccggtcaatatcaccggatatgctattgcaccagcgaccatgtgcacaaaattatttgtaatttattaatttattattggactgt

SEQ ID NO: 117 - DNA, 229 bp, Ctenocephalides felis
  misc_feature (181)..(181): n = unknown at position 181
  misc_feature (185)..(185): n = unknown at position 185
  misc_feature (187)..(187): n = unknown at position 187
  misc_feature (192)..(192): n = unknown at position 192
  misc_feature (205)..(205): n = unknown at position 205
  misc_feature (207)..(207): n = unknown at position 207
  misc_feature (211)..(212): n = unknown at positions 211 and 212
  misc_feature (215)..(215): n = unknown at position 215
  misc_feature (217)..(218): n = unknown at positions 217 and 218
  misc_feature (222)..(222): n = unknown at position 222
caggatttcatggtcttcatgttttaattggaacttcttttcttattatttgtttactaccacttagattatttcattttaatcctaaacatcattttggatttgaagcagcagcttgatattgacattttgttgatgtagtatgattatttttatatatttctatttactgatgaggtcnattnancaganaggaaacctgtananccanntgnannaaanaaaaaaa

SEQ ID NO: 118 - DNA, 469 bp, Ctenocephalides felis
atttcggacgaccccaaaaataatatcgacgaggaaaaacatttgaaagtcgtgcaatttaaggacaacaagcccgaagacgacgcggtggaaatttccgaatatttcagatacaatgacgttatcaaagaaggcgatattttagtgcgggctccggcggaacgacttattcacaaactaaaggacggcgacgactgcgtctgcatgaactggagggtttgcaaagggaaaataatcgacggtcacccgtgtcctcagagttacatagacgtctgctgccaaactgagcagaattttgatgaagataaaaacgaggagcagttgacatttaggaaattattgttatcgaaacaataatcatgatattttttgtaacatttataagtgcacttgtgaaatgtaccaaactttgcaatttggtaaataataaataaacaaatttgtttaaaaaaaaaaaaaaaaaaaaaaa

SEQ ID NO: 119 - DNA, 500 bp, Ctenocephalides felis
  misc_feature (428)..(428): n = unknown at position 428
  misc_feature (444)..(444): n = unknown at position 444
  misc_feature (460)..(460): n = unknown at position 460
  misc_feature (467)..(467): n = unknown at position 467
  misc_feature (475)..(475): n = unknown at position 475
  misc_feature (491)..(491): n = unknown at position 491
gttcttacttatatctagattatcaggtttatcgagctctagaatacgtctaagaataccatattgtatactcatttattaaatggaacatatttttaaagtgaatcaaaataaaattcgtatttgacactttggtatttgtaaacaaaaaatgagcagcaaatcaaccaatagtcaccaatatagtagtatctgtctagaagtgactcaaatgataaacacaactgtgatcataaaaattcaataaaagacgagaaaatcaagatcatgttaaatcaaagcatcgttcaagatctcgtagtcgttcatatgatagaattgattcacatgatagattttctagtaaagaaattacaacagagattcaaactttctcatagtatgaaaaagttccaacttagaatcatcccgttcaaaaacattgcttngccttttccacacatnagccaccttggggccnaggatantagcatangcacaaacttgaattngctgatcaa

SEQ ID NO: 120 - DNA, 218 bp, Ctenocephalides felis
  misc_feature (186)..(187): n = unknown at positions 186 and 187
  misc_feature (197)..(197): n = unknown at position 197
ctcgagttttttttttttttttttagaaatttactgaaacagaatactttagattaattattatatacagtaaacaatcttgatgtgatagtttatttttgagcaatatatttatctcttaggcaaaatattattttatgcataactgtacatttattatcaataaaaaatataatatgaccacannttttttaaanaaaaaaaaaaaaaaaaaaaaa

SEQ ID NO: 121 - DNA, 500 bp, Ctenocephalides felis
  misc_feature (460)..(460): n = unknown at position 460
gttattttctaatctgtaccatcacagtttactcgagaagttatggatgatttcaatttgctgttagaattgccatgtccagataaaagaattgcagaaatattatacgaagtgttgatgatcgacgcggaaccttcccggagtaccgtgaaaaagaagtttacattagaaaacaacgttataaaagtgccgttgttcaagtccaaatgtgaaaaatttacgtgtcgccgtgaatggtttgtttgacaatttttatttggttctgcaaacgattgatacttttgggcccgcaaaccccacctatgattactattttgctgatttaattgcttccaagtgattcttagcaattcaaaatgccagaacacacacctgcccctacaccgagcagagcggtgtatggatttgcattatatttaacaatgaaatcttgttttttgcttatgttgtatggtctatngtacctgatgatattctcttatgctgaattatattatctc

SEQ ID NO: 122 - DNA, 500 bp, Ctenocephalides felis
  misc_feature (490)..(490): n = unknown at position 490
tataaatgatttaattcagaagcaaggcagttatgtaattttttgaatatatgtgataagaaaaacatttaaaattatattagtgttaagtagaatttacgtgaaagtaagatgtgggtttattttaatagaatttttgctgcggtgttgattatattggcagtgtcagcaagggaatcgaattcccaaaaacttactgttgatggatttaaaggtgatcctatagaagaatttcgtcaggaatattctacgtttttaaaaaagggcgaagtatcaaagaagttacaaaaacttactgatttactattaaaaccgagtgatgaaaatgattgtgcaaaatgccaaattttggcaacatttgcaatcgaaagaagacgtaatgggacttccaatgcagagatgaattctttgatgaatgatatgtgtataagattaaatatatggataggaaaatgtgtgaaaacatgatatatatgcatttggatatcgnctgatataat

SEQ ID NO: 123 - DNA, 500 bp, Ctenocephalides felis
ggatgataaggatcttgtattcatcaccaaccccgatcaaagagaaaaagattgtaaaggtttcttgatcaatttgattgattcacctggacacgttgatttctcatctgaagtaactgctgcacttcgagtaactgatggagctcttgtggttgtggattgtgtttcaggtgtgtgcgttcaaactgaaaccgtattgcgtcaagctattgctgaacgtattaagcctgttgtgttcatgaacaaaatggaccgtgcacttttggaattgcaattggactctgaagaactgtaccaaactttccaacgtattgtggaaaatgtgaacgttatcattgccacatactctgatgatactggtccaatgggtgaagtcgtgttgatcccagcaaaggttcagtggttttggatctggcttcatggatgggcttttactctaaaacaattctctgaaatgtatgctgagaaattcaagattgatgtactaaattgatgaacag

SEQ ID NO: 124 - DNA, 500 bp, Ctenocephalides felis
  misc_feature (5)..(5): n = unknown
  misc_feature (86)..(86): n = unknown
  misc_feature (134)..(134): n = unknown
  misc_feature (177)..(177): n = unknown
  misc_feature (189)..(189): n = unknown
  misc_feature (254)..(254): n = unknown
  misc_feature (285)..(285): n = unknown
  misc_feature (306)..(306): n = unknown
  misc_feature (332)..(332): n = unknown
  misc_feature (339)..(339): n = unknown
  misc_feature (411)..(411): n = unknown
  misc_feature (419)..(419): n = unknown
  misc_feature (485)..(485): n = unknown
gtttngtttcttattgtttagctatttattatcaaaatattaaatcttataatgctggtatatcaactgttttaataaatcgaatnggggatgtgactttattaattagaatttcttggataataaattatggnagttgaaattatttattttatataaaatatataataaataatnttgaaataatcntaattatatttttgatccaattcctgcaataactaaaagagcacaaattcctttttcttcttggntaccagctgcaatagctgccccaactcctgnttcagctttagttcattcttnaactttagtaactgctggggtatatntaataantcgatttagagaattattaataaaaagtaatttatttatttatttattattaatttctacattaactatatntatatcangattgggagctaattatgagttgatttaaaaaaaattattgcttatctacattaagacaattaggnttaataataagaagc

SEQ ID NO: 125 - DNA, 436 bp, Ctenocephalides felis
  misc_feature (346)..(346): n = unknown at position 346
cgccaacctcagatatagtggcaggtcctggttccaatattcgaataatgggtggttccaactcgcgcctaaacgcacgatatgctaccaaacaacttctgatgagccatgctgagaaacgaattaatcggaatagttactccacggatatttattaagttatttcataataagtgctttgacatgttagattaaaagctttattttctgaagcaactttaaattttaggaatttgtattctacaaatgttgtagaacaaaacggatataaagatacgcacaaggtgcataaaatagaagaaaatgaaaaagtaagccaaagatttagcaaatgttcaaatattgnagtttcaaatattctctcaattctttttgataaatatctaattgcgaattaataaaatgtctgaattattaataataaacagattagcag

SEQ ID NO: 126 - DNA, 500 bp, Ctenocephalides felis
  misc_feature (6)..(6): n = unknown at position 6
ctggcnctttgtatacataccccgagaacttccgtgcttacaaatctttaatcgctgccaaattttcgggtgctaatgttaaagtagcagccgattttgcattcggagagacgaataagtcagaatcgttcctcaagaagttccctgcgggaaaggttccagcgttcgaaagcaacgatggaaaatacttaagcggcagcgatgctattgcttattatgtatcaaatgcccaactacgtggcgcctccgacttggaaaaggctcaaattctacaatgggtagattttggcaatggagagattgtgcccccatcgtgtgcatgggtgttcccaattttgggaataatgcagttcaataagcaaaccactgaccgtgcaaaggaagatgtcaaaagtgccctttccgtcctcaatactcatttagtaaataacacatatctcgtcggtgaaagaataactttggctgatatcagtgtgttctgtcattacttcacctgtcca

SEQ ID NO: 127 - DNA, 500 bp, Ctenocephalides felis
  misc_feature (468)..(468): n = unknown at position 468
gagttctttaccctcactgaaaattgctttattttcctcaaattgcataatttaaaaatgcttttgacaatagttcatttgaacatgtgcacattttaaatactttattttatttaagtgtgatttagcttaattgttaatttttaattcatctactgtagactacaacaatggccaaatttctggtacactcttcaatttttggttgtgtcagtattgtgagttatttcatcgggtgcaatatcgaaagaaaaaatatattaaaccatttcaaatcccaaaacattgatttgaatgttttgagcaaggtatgtacatacataaaaattggttgcggttggtagtccagaaaatcgcgaatctgtgtaactgaggactggataaatgagattagttggtcatcctatacactgaacacttgaagaatataaaaattgtatttgtaattcacagatcaagaaaggctgnttaccgattttggcactgttcagcagcaactc

SEQ ID NO: 128 - DNA, 500 bp, Ctenocephalides felis
  misc_feature (6)..(6): n = unknown at position 6
gcagtncggtaaaaacctcaccaagtaattcgctccatgattagatatccggagtgattacccttatcagtgcagttgtcgcaacgtggtgttagcagttgtggttatgtgcgtagttttttagtacattagtgcccgtttgagtgttaatattgagtttttttttgcatcaaaaaggattaatgacacgtgcttttccaagtatactttggcatgagggaatgtcttgcgcgctgagcgcaacgtaatgcgaagaactcgtgctgcggtcatttgctgcagcagcagaaggccgcgtgggcggagacggcgcttcactggataatagaaaattcaaaatttttatctaaccatttgtcttaaaaataatcatacgaaatactctaccatttagtaattaatcttccttctgcaaaccttcaactgatcaatttgatatgtgatatactaatatctattatattatttaataactaagattttatgaatctgtattatat

SEQ ID NO: 129 - DNA, 500 bp, Ctenocephalides felis
  misc_feature (4)..(5): n = unknown at positions 4 and 5
gatnnatccgatttcggttgtgcttgggctagtgtgttcctgctatcatttgatcttttccctccggaagaatttgaaaatgcaccagaccttacattactttgatacggagatggtgctgctctttgcattacagaattgccagcattgtttgtcggaccacttggccctacagctgggggcggagtaaaacttgttctttgtggaaagtttggccctgcatattgacgaatgtttgaattttgtggaggtggatatctattttgtgtaggactggctgtattggctgtcactcccgcaacaggaaatctttgcgccataataacttaacttaaatgcattcagaaaaataccttaaacggtatcaatgattttcacaattcataattaaaataggtaaaaatgcataaccttataaactaataatacatcgaaatgattttgcagttgtataataacgatattctttgaagttggataaacacgaatattaaaactta

SEQ ID NO: 130 - DNA, 500 bp, Ctenocephalides felis
aaaataaactcttacacatatttttagatatacagacaatatatttatatcttattacgtatacaatatgtgtatctatattataaatacatatattgcatcataaataatttggtgtattctacatttgtcaatggtcctaaaattacaatcgatcaaaattaacacttcaaacctcattcattcttgaaaatgtaacacaatattagaaaattaaactaaaaaagcatattttcacacgctattaaatttacacaaataacatcaagcaattaagcacttactttaccacatctaatgcatataataaaaaaaaaaatctaagctaaggtttgtattattaatgtaattatttggtttctattgcgcaattcatatttccaaggtgtcaattaacaagtgatctttaaattaaatataaactgttactttatattgttttaaactatcaccaaatttatgtgatgaagtctataatttggtgattggcaaaaatttcc

SEQ ID NO: 131 - DNA, 494 bp, Ctenocephalides felis
tgtaactagaattttatttttgtattaatatttaatttaataatttgacatgaaaatttatcgttcagctctctgatttcaaaggattctaagcaagactacttgtttaaacggtataagggcgactcctgaaaaaacgaaatgaagaaagtgaagcgagtcagtgatgtgggggcagtgggtccaccgccgacagcccctccatcctatatggctgagcctcaatatgcacctataccgcaaaatcaaaactttaatggaagtataaatcctaattatgggtacaatcaacaaactgcaaaccaaccatttgtgccatattccggtcaaccaaattacggacaacagagtcctgctcagttccatcaaacgccgtctaatccaatgatgtcttcgcaaataccaaatcaacaaattcctggtccccaaaatatgaatattccaccacaattctcaatgtttcaacaacccttggtcaaggaatggcaattcag

SEQ ID NO: 132 - DNA, 500 bp, Ctenocephalides felis
  misc_feature (4)..(5): n = unknown at positions 4 and 5
ctgnnacagtgaatgacataagatggcgactagtatatgtgtttctaggtgccagatattgtttaaaaatgaaataaataggataggactgcgggcactgttttatacacttcagggctttaaagaatctcgacataattccatccacacgtgcgcctcttcacacccaacgctagtgcctaatgatcgcaacaatttgacgcctgtcatcagcgcagctaaaaaatcatcggaaaatgaggctgtcgaggtgacgtacgctgccgggctgccacaaataaccgttccgctgccaagcaggcgagagcggtgccgattcacgttgcgaccggtcacaaacaccgtcggcgacttcatatctatgctgcgctccgaggaccagggcgtcgatcgagtagtttgcgtaacctgctccggaatacgaattgctctccgacagcatcgaagctttactcgaacggccttcttttggtcatcaacgacaggaagttgaggtagat

SEQ ID NO: 133 - DNA, 500 bp, Ctenocephalides felis
  misc_feature (4)..(4): n = unknown at position 4
  misc_feature (10)..(11): n = unknown at positions 10 and 11
  misc_feature (17)..(17): n = unknown at position 17
  misc_feature (36)..(36): n = unknown at position 36
atgntttatnnctaaangtgttcaatgcattctgantttgcgttgatgagaagtgattagtatcaaaaatttataaaatatgtggaagtttattcaattcacgatatttttcagcgtgctgcgatttggtgcaagtttggagtgttacagttgtgaacttgcaaagaattcgaactgcacagttcctctggctggtactctaccagttgcaacaaagcacgaccatattctaggaacaaaatttttcattcatttttgaaagacaattcgacatatgatttagatgaacttgagaaaaacaaagaagaagaaagcttccgatgtctgttggttactggagaaagagttttcaatcatggatttatagaaaaaggtgtgattagagaatgtgtccctgccgagtcacatgtgaagaaataaagaaagatttaacaaataaaggagcccgggatctaaattgcaccatgtgcgacactgacttggtaatgggtcttagacct

SEQ ID NO: 134 - skipped

SEQ ID NO: 135 - DNA, 500 bp, Ctenocephalides felis
  misc_feature (4)..(4): n = unknown at position 4
  misc_feature (7)..(7): n = unknown at position 7
  misc_feature (35)..(35): n = unknown at position 35
gatnttntcgaacaattcaatctaccaagtttatngcgaacaattgataataaaaaataaataaataattacttgtgtccggatgaacgaatcatgctcctaaccccatttggtgaagatggactctactaaacctttttgtgaataatgaacagtttttgtcagtgttcaccaactatcaacccccgatactaattaagtgcgactgatcattaattgacatgtctcgagtgatttacccaaagcaattaactaattaaccaattacttaagtacagctaattacaaacccagcgaaaggtacacatacctgcacaactgcatatactcacatttcaataatatgaatatttcctgttcatgtaaaccactcaattaatttaatcactgataaattgaacatttaaatttccttcttgaatacgaataaatttacctaaattagagtcacggctgtttattaaactttaattatcaattaatcaaaaaatgccatgcca

SEQ ID NO: 136 - DNA, 549 bp, Ctenocephalides felis
  misc_feature (6)..(6): n = unknown at position 6
aaagtntaatatatatcttttaatataccgtttgtttcatatataaaacattaataaaatctaagataaacaataccaagttactatcatagataagtaaacataactatactacggttactatatgtacttgagttcactagaattttgttttctataacaaatgctacagaagtgtagtattaaaaaacaattaggttctcgaaaaggcgcggcatcttcagatttccaaattgcatctaataattcactgcaactgactttccaatcatctgatgtcacagacctcaaatttcttctagaaactgaaagatacatctattcaatattggaaagaccatttttaattttgtaatgttatatgaacaaattttatatactaaaattgaatcatttacagtaattttcaaattaacccgagattcacataatcacgctcataacacattcatgcacatgggaaaatttcaagtgtcagggacttggtaccttttctactatcctcaaatactacttcttggatcattatcattttctggttcgctctct

SEQ ID NO: 137 - DNA, 549 bp, Ctenocephalides felis
  misc_feature (7)..(7): n = unknown at position 7
  misc_feature (499)..(499): n = unknown at position 499
  misc_feature (523)..(523): n = unknown at position 523
  misc_feature (537)..(537): n = unknown at position 537
gtgcttntatgctatttcaataaatgtttgttgaatgaaaaggaaatttattgttgttttgggtgcattgttttggcactagtgataaaaacttaaatgaaatttgtgtgtttataatgtgattttctttaattaaaaattatttaaattctctggtgtatgttaagttgatcaaagtaaacatgaaaccttatcatcgaacattagttaattattgatcataaaataatatttggtgaaatgacctaaaaattcaataacattttgcttaaacaatatttatcactacataaaaaacatgctatgaattattgcgttgattaagttccgacactttgctatattatttaataaatattttatttattttaattgtgattaaaaacttttatcgggtaattgctaaacttaattcgatattttttgctaacgcatttttgcggaatggctggatttatagaagttgccatatgtttggctattctttactggctattcnacgcaagaccgccagcaatggtangtgtagtggcagancgaatgtggtct

SEQ ID NO: 138 - DNA, 392 bp, Ctenocephalides felis
  misc_feature (33)..(33): n = unknown at position 33
  misc_feature (380)..(380): n = unknown at position 380
agatttgaaacaaaacaatttgaagataaagtngtacttacacagaatgaaaaggattttgaaaaaaatgttgaaaagaaagaagcaaacgtaaatttagaaacaaataaggaaacatctgtgaaaaataaacttaacgaaggatttataaaaatcaaagatttttttaaattttaaattttattttatcatccaattttatttaatttttatgtcatgtatcatcaaataatgaaatgaaagcatgcattaggataaatgtcaacatatatatagcaaagtcgttacatattttgttaataatatgaaatacatttactatggtattaatttttgttttagatactttatttagaaataataaatataaaagacccggnaaaaaaaaaaaa

SEQ ID NO: 139 - DNA, 549 bp, Ctenocephalides felis
  misc_feature (5)..(5): n = unknown at position 5
  misc_feature (7)..(7): n = unknown at position 7
  misc_feature (517)..(517): n = unknown at position 517
gtcantnataaaaaaaaaatttttttcaaaaaaaaaaaacaaaaaaaaattaaaaaaaaattttttttaaaaaaaattttttttcaaaaaaaagtaattttttgtccaatttatagtttcttaaaaatcgtattttttcgaagtaaattttttttaaaaatgtcaatcgtttttaaaaaaataataatttttggtacgggaagttccagcaatttgccttaaggcacgatgccttaattgccttaagacagaattccacttacagctagtttttacttgatttgatagaggaatagttacagcaactatccaggtttattacgtataaatatgatcagtcgatttcaagatatattaatttagaagaaattgttacaactagcccctatctagcttccctacttagatatgtttacttagatattcccttccctacgtagatatttttccatgattagaaatttatttataagtaaattttcttttttattcgttagtattaaatataaggttatgnatttatatctttgggataggtatacatgagta

SEQ ID NO: 140 - DNA, 115 bp, Ctenocephalides felis
  misc_feature (3)..(3): n = unknown at position 3
aantttagttacatagttatatagaggatgagaagtttaagtttgtagcttattttatcaataaatgttcaaaattatgaatcgatatattcataactcaaaaaaaaaaaaaaaa

SEQ ID NO: 141 - DNA, 549 bp, Ctenocephalides felis
  misc_feature (537)..(537): n = unknown at position 537
  misc_feature (540)..(540): n = unknown at position 540
attttcaagtacccattcgctcgatctcgaagccgcacgcagacatttttatttaaataacgattatgtagcataattgaataatttttccgaattgtaataatgtttttatcttccgatattgataaacattgacctgatgttcctgcaaataagattttcttttctaaaacgaaacctgaaagataccacatacttttcctcatgcatgtaagataaagttttgtggaattgttttaaaataaaggcaagatgcggcgaagtactactaaacgttctatggtgactgattacgatgatagaagtctggggccagtgcttaaaaaatccaatgctagtcctgatttatcaatggtcaaacagtacacatcaattagccctcagcagactactgttagttatcatttggtggatcatggctacggtgctactcctcaacatcaaattatgcgggacataccagttgctccacctaagaccacagaggctgtcaaacgtcgacttaacttgacatgacaagttcagtcccagttcctnctnctcgaccaa

SEQ ID NO: 142 - DNA, 375 bp, Ctenocephalides felis
  misc_feature (68)..(68): n = unknown at position 68
  misc_feature (210)..(210): n = unknown at position 210
  misc_feature (253)..(253): n = unknown at position 253
  misc_feature (292)..(292): n = unknown at position 292
  misc_feature (329)..(329): n = unknown at position 329
  misc_feature (366)..(366): n = unknown at position 366
agagcagaggggcattagaaaataaactattagcagctgctgaagatctgagaaaaactttaagaganggtggtaatttgactaatggcgaagttatggatccttggttccttgaaaatgttgatgctgacattgaattccaaacattgccaagttaaacggagctcttgccaatgtaacaagtagagggtttgtctagtttcaacatanatcacataaaagtgaatgtgctcttcatgaaagctactttcantatcactttttgaccacctcatggcaaagggtctatacnacatttgaaggcaagttggcagatttgctaagttgtntggcaaaggctcctttgatattcatgttacgtgatantaaaccgct

SEQ ID NO: 143 - DNA, 533 bp, Ctenocephalides felis
gaagtttactaacgctttgataaagtatcctaaataaaagtataacggtggtttttgattgaattaattgtaaaatcaataagatataaagttgttaaataaggtaatctgtgctagaaatgtatattgtgctccggagtcgagaaataatctaaagtttagccgtttgtcaccgagacgctatttctgacagttacatatcaataaaagtatcatatcttgttctgattcgtgaaatttacaataatgtctgagttaatgttatgttctgaacactgataattactgtttagtgtttttcaatagatttcctcaaaactgttctacagcagtggactcagaattgtgctaaaagcaagccgaattcggctttaataaaaaagtgaaaattattgaccttccatccgagaacgatacttttcacaatcagtcagactttctgtaatgtacccaaatatcttccaagagcacacaccaaagaaataagcttcgttctccccgttacttgtacactcaaaaaaaaaaaaaaaaaa

SEQ ID NO: 144 - DNA, 414 bp, Ctenocephalides felis
  misc_feature (284)..(284): n = unknown at position 284
tgcaaaatttagtgaacaatcgccaaagcaaaatgtatagtgttagagactcattagttttagtattgcttgcttgtctggtcgcgccaagcttacaggccactcctacctacaaagctggcgtcgtagaatactatccgtcccagaatgagaaattcgaagagaaaattaatgaaaatttgaagttttatgaaaaaacaattgaggaagcagaaggcaagaaggtagacatcctagtgtttcccgaagcaaccttaaatggtggtatcaaaactagagaagangccaaggaacatggtgctgagatcaaatttccaaataaagacagtttaggcccaacaaaattaaaacagccgccgtcttttttggaaaaattatcctgtaaagctatggaaaagaaatctacgtagttgt

SEQ ID NO: 145 - DNA, 350 bp, Ctenocephalides felis
  misc_feature (4)..(5): n = unknown at positions 4 and 5
gaanncatctatcaaaatggccaaacgtaccaagaaggttggaattactggtaaatatggaactcgttatggagcttccttacgtaaaatggtcaaaaagatggaaataacccagcacgccaaatacacttgcacattttgtggaaaggatgccatgaaacgtagttgtgttggaatttgggtcttgcaaaagatgtaaaagaacagtagctggtggtgcctgggtatataccacaactgctgctgcctctgtccgatctgctgttaggaggttgagagaaacaaaggaacagtaatttatattgatcttaataaataattaataaaaattaaaaaaaaaaaaaaaaaaa

SEQ ID NO: 146 - DNA, 217 bp, Ctenocephalides felis
cccttcagtatttcttttattttcaattacgaaaatcagaaaacagttattccaagatcatggttcttgttcccttctttaagtttatttcctatcctaaagtgttaactattactacctaaactgcgatgatatttgtgatgaatgatgttgacatgatgtccgaagacgttggctaagatgcggtaaaattctgttcctggtcatcatcgttccc

SEQ ID NO: 147 - DNA, 489 bp, Ctenocephalides felis
catttgcaagaattatcagtgtaatccaaaaacaatcctgtccgcacgcaagcaaagggttgcgatggtcctggtcctggtggcggtggtggaggtgcagctgtcgccaagcactcggataaaggcgcttgcacgcattgtgggtaaagcgcgctgaagtatgtctgtccggcgcatgtaaaacgacccacgttgaaatttcctccagagagtctcacacattcaaaatatactttgcatgttttgtctgctggatctgcaaatgagccgctctgcacgcagctgtatatgggcggcggcgtaggtggttgccaaggcgctggaggatttcttaggcactccgaaagggaagcgaccacacattgctgatagaagtaagtagaaccaaggacaattgtaacgcgctacactgaatcctccgcctgctttcaaagcacatttgtagtatcctttgcaagtgctgtcatagggatctataaacatcccttc

SEQ ID NO: 148 - DNA, 489 bp, Ctenocephalides felis
aaaaggtttacaagtctcaaagattccgtgcaggtaaaggtaaaatgcgcaacaggcgtcgcatccaaagacgtggtccattgatcatttacaaccaagaccagggattgaagaaagctttccgcaatatccctggaattgaattaatcaatgttgaaagacttaacttgttgaagttggcacctggtggtcatgttggtcgtttcgtgatttggactgaatctgctttcaaaaaactagatgagttgtatggaacctggaaatcgtcatcaaaatctaaagctggttacaatctaccacaacctaaaatggctaacactgatttggctcgcttgttgaaatctgaagaaattatgaaggttcttcgtgctacagttactcgcagggttaaaaaattgaacccattgaccaatgcacgagccatgcttaaattgaatccctatgcagcagttactaaacgtaaagccattcttgctactaagaagaagc

SEQ ID NO: 149 - DNA, 289 bp, Ctenocephalides felis
agttaaggctctatattgctggctacctcttgctgtcaaaggtgcgaagccaggcatgaagaaatgtaaacgtgggaatggaaccatgtttacagctaattttctcaaatcagcattaagttgaccagggaaacgaaggcaggtggtgacaccagacatggtaagagaaactaaatgattcaagtctccatatgttggagtgctaagtttcaatgttctgaaacaaatatcatacaatgcttcattatcaatacaataggtttcatcagtgttttcaactaattgatgt

SEQ ID NO: 150 - DNA, 171 bp, Ctenocephalides felis
tgcttggagaaagtgcagttggaaaaagttctttggtgttaagatttgtcaaggggcagtttcatgaatatcaagagtctactataggtgctgcgtttttaactcaaactgtgtgtctggatgacacaacggttaaatttgaaatttgggatacggctggacaagaaaggt

SEQ ID NO: 151 - DNA, 413 bp, Ctenocephalides felis
  misc_feature (405)..(405): n = unknown at position 405
acacaattagcaataggaaaatctagccacaaatatttttaacaatttatttaatacttatgttctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatatanataacggt

SEQ ID NO: 152 - DNA, 418 bp, Ctenocephalides felis
  misc_feature (402)..(402): n = unknown at position 402
ttgacaagcaaaataaaatacatcaacgttgttttttacggccacttgcaagttatttaatggttccattttttgaacaactccatttgttccaagaaccaatgatgtttcatatgtttgtgatggttgtaaattcggaacttgtaatggtgcaccaggtgccagaccaaagctgtttttattcaactgtatggcaaaaccactcatagcttgcattgctttgttggtgtagctcatgtccatgtaaatctgtccacttctcctggagaatgttccatatatttccaaacctttgcccttttcagctggcaaccacaatgcttttggtataacaaaagggccagctgatcccacagagaatatttctcccagaagtccagagttaccgatgttattaagtanaattgacatctgatgt

SEQ ID NO: 153 - DNA, 340 bp, Ctenocephalides felis
  misc_feature (196)..(196): n = unknown at position 196
  misc_feature (285)..(285): n = unknown at position 285
gaatactggttcataaaatttagaagccctaatttaccgcctacggcgatatgatgatcagacatatgtccgggcttgtccaaaaatgtaaaatgcacatgggaattttccaatggcgtccacttatgaataatattgggaagtcctagcaattgcgttatcaaattttcctgcacgggttgaaaacaatccttangcatcttcaaatcatcccttacaattttaccctggttaattaatttggtaaactcgtcaccggatttgtcgagtgtcttaactttatcngcgatgctggttctgcacgcgtccaattttcggcgtgttttgtccaaatcttggt

SEQ ID NO: 154 - DNA, 498 bp, Ctenocephalides felis
tacgagtgcacattaaacgctcgaggtgtattcgacgtggcccgatatgcttgtgcagctgagttatatttcaacagcgttctgcagcagtgcgtacctgcataccagtcagactgtttaggtgcaagtgtcacttcttccccatccataccatccttaccatccttaccatctttcccaaccttgccaacatcttccccaacagcaggatttccttttggccgaaaatctcttgatatgcaaacaaaaactggaactaaatgtacaaaaggagaagtttctaaagacgatttaaattctacatgtacctagtgagtgtgttatatgaaattgctattgcatattacatacaagcttaataaaggttatggtgatttatttcatttaaaggcaatgtatcggtttaatggttttaaatttatttttatttaatattaaatagattaattaaaaatctataaagtgataagaggctgatatccataatattattgaata

SEQ ID NO: 155 - DNA, 102 bp, Ctenocephalides felis
agaccaagtaaaaatctcactcacagcttttaccttattaggatcatttaaaaatctatctagaatgccaggttttgccagagattgctgcactttcttagt

SEQ ID NO: 156 - DNA, 462 bp, Ctenocephalides felis
aatttgcggaaacacctcagattttagcggcagcggaagaaatttgtggaccttatgtctggggccgttatgatttacttgttttacctccttcattcccttatggtggaatggaaaatccatgcttgacatttgtaacacctactctattggctggcgacagatcgctagtgagtgttgttgctcatgaaatagcacatagctggactggaaatttagtcacaaattgcagttttgaacatttctggctaaatgaaggtttcactgtatttgtagaatacaaaattcagggaaaattgcatggtgaagatgttagagactttcattcgctttgcggactcacaacattgaaagaagaggttcaactattaggtgaaaccaatcaactgactgctctcgttgttaacttacaaaatttaagtcctgacgatgcattttcttctataccttacatgaaaggct

SEQ ID NO: 157 - DNA, 194 bp, Ctenocephalides felis
atcctttttttctatgaacggttttaggtaacggagaataatgtaaggcatcactaaagtcgtttttatttgtgatttcatgattaggctcgggtcttctgacccgcataaattgaccccgcaattttgcttcctttgcctcgtttgatgatacagcccgccaatccaaaaataataattttggtaaatgatgt

SEQ ID NO: 158 - DNA, 265 bp, Ctenocephalides felis
  misc_feature (58)..(58): n = unknown at position 58
ttttttttttttttttttttttttttttttttctgcatcagataatacctcataagcnggtcctagatcttgaaacttcgaggctgcatctggatcgtttttattcttatcaggatgcaattcctttgcttgtttcctataagctttcttaatttcatttaacgtcgcactacgagatacttttaatattgaatagaaatctcgtccagcgctggctagtaaaaaataaatacttaagttaactaacactaaataacacagtttg

SEQ ID NO: 159 - DNA, 498 bp, Ctenocephalides felis
cttggcatctagttttgtaaattcagtttggctgtttattttgctgcgatatttcaatggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccagaaagtcccaaatttttgatgaatcagggaagaaacgaagaagctcgtcaaattattgccaaaatgtatagaattaatactggtaaaccagaaagtgaattccccgtatcatcaatcttagatgaatatccaggagtggatggtgaaaatacaaataaaacaaagaaatc

SEQ ID NO: 160 - DNA, 617 bp, Ctenocephalides felis
  misc_feature (573)..(573): n = unknown at position 573
  misc_feature (577)..(577): n = unknown at position 577
  misc_feature (579)..(579): n = unknown at position 579
ccatttgcaaggaattatcagtgtaatccaaaaacaatcctgtccgcacgcaagcaaagggttgcgatggtcctggtcctggtggcggtggtggaggtgcagctgtcgccaagcactcggataaaggcgcttgcacgcattgttggtaaagcgcgctgaagtatgtctgtccggcgcatgtaaagcgacccacgttgaaatttcctccagagagtctcacacattcaaaatatactttgcatgttttgtctgctggatctgcaaatgagccgctctgcacgcagttgtatatgggcggcggcgtaggtggttgccaaggcgctggaggatttcttaggcactccgaaagggaagcgaccacacattgctgatacgtgctgctgaagtaagtagaaccaggacaattgtaacgcgctacactgaatcctccgcctgctttcaaagcacatttgtagtatcctttgcaagtgctgtcatagggatctataaacatccctttctgcacgcatgaaaaaagaagcggcggtgctggtgtaattggccgtagtcgtagtaatcggacaattggaggangcanangtgtaattaaacattccgaatatgtagggcccacacat

SEQ ID NO: 161 - DNA, 450 bp, Ctenocephalides felis
  misc_feature (34)..(34): n = unknown at position 34
  misc_feature (65)..(65): n = unknown at position 65
agaattagaattgacacaaaatgctttagtgaangaaatgaaattaaaattgatgattattgatngattttataccaaatgaaatcaaagataaattttatgcaaatgcaaagtttgatgaagatttggacatatggacagttgcaataactaaagaaatgttgccaccaagacgaccgatatccaaaccaggacggcgcaggcctatttctgaggtctctttggttaaaagacattaccctggcttggcaggtatacgtcacagaggtgagaatattattgagtatgacttgggcatgccatttcgcaccacatttgaatacgaagccccaacagtgtccccagcgttacaatcagtattagaagatgctttacaaccagaaggagatttagaaatcacttcaccccgtcaaccgtcttcagactgcccaaatcatgaaaagacctagt

SEQ ID NO: 162 - DNA, 420 bp, Ctenocephalides felis
ctgaattccagatgtagtgaagtaaggaatctcaaatttcacttgtattgggggttttccttccgtatcttcacattccacacttggcaatccaaaatgtgctctcattaggtattctttaccacctggaaatgattttatggaccaagtaaatgcattcaaatcaggagcatatttaacacttccaattgttgttttaaacttcggggaatctgcatcagctggtacaggaatcagtatctccacattatttgcagttgaccgtcttttaaattgtgacttagctttgatcatgtattctacacggctgtgtgcgtgcctttcaattactgattcaatccatatcaagggttttacatgtgtgttaagtcgataagacattaactcaaactctccatcaggaggaataaatgatatggt

SEQ ID NO: 163 - DNA, 498 bp, Ctenocephalides felis
  misc_feature (27)..(27): n = unknown at position 27
tacaatgggaattgtcatgttcaaatncttggctgcggcaattataccttcggctataacatcacacctcattattcctccaaatatattcactaaaatagcactgaccttaggatctgttgtgataatcttgaaagcttctttgactgtagaagcagtggccgcaccgcccacatctaaaaagtttgctgggtctcctccatgtaatttaattatgtccatagtagccatggcaagaccagcgccattaaccatacatccaatatttccatccaatgctatataattcaaatcaaattttgaagcttctacttccttaggatcttcttgagtccagtctcttagggcaaaaagttctttttgtcgaaaatgagcattgtcatcaaagcgcattttgcagtctaagctgaaaaatatatcctcagatttccttgatatttcttttgaatcttcagcaaatggattgatttcaatgagtagtgcatctttctttaaaaa

SEQ ID NO: 164 - DNA, 218 bp, Ctenocephalides felis
  misc_feature (12)..(12): n = unknown
  misc_feature (70)..(70): n = unknown
  misc_feature (74)..(74): n = unknown
  misc_feature (87)..(87): n = unknown
  misc_feature (108)..(108): n = unknown
  misc_feature (125)..(125): n = unknown
  misc_feature (129)..(129): n = unknown
  misc_feature (157)..(157): n = unknown
  misc_feature (160)..(160): n = unknown
  misc_feature (163)..(163): n = unknown
  misc_feature (206)..(206): n = unknown
cctggtggtttntggtagtgggggttttggtggttctaatgggaggatttggtggaggattttggcttangggntgggaatcggganggttccattggtttcattcangtttgaacttggagcanttgnggatgggcttatttcatcattcgttgantgnggntgggcgtctttaacgtcactggtaaataaacgcctgggcccanggtcaagtctgt

SEQ ID NO: 165 - DNA, 373 bp, Ctenocephalides felis
  misc_feature (44)..(44): n = unknown at position 44
  misc_feature (50)..(50): n = unknown at position 50
  misc_feature (300)..(300): n = unknown at position 300
  misc_feature (334)..(334): n = unknown at position 334
  misc_feature (359)..(359): n = unknown at position 359
caaaaatgggcacctcaactggtgcaaaacgtttttggcttttnttgggnccgtggtctttagacaaacgtgccagagggcttttcacgaaaaccaaggggagggcattgtcattcctgagaagggcgcaagcaaaaagttctcaagggcagagttattgcagttggcccggcaaagaaaccaactggtgaacatgtgcccctaggaatcaaaagtggtgacatggtttgctgccgaatccgaggcccaaaagttgagctcgaagagaacaagaattccttattcaaagaatccgatatncttgccaagttggatatcgacgaataaattgccnaaaatttaccatctttcacaatttncccaacacaaactg

SEQ ID NO: 166 - DNA, 390 bp, Ctenocephalides felis
aaatctccgccctgcaatcttccccaaaccaaccaaccgatcaaataggaagccaactccaagctgtccaagttctcccaacaaacctcggtttgcacacacacagacaccaaaacaactatgctgtaccccaacaaaccaactttggatcctttcaccatcaccaacaaatcgcacccacaaatattgggggctactactccccccacggaattctaccaatctactacgataatgggcacggattgttgaattttaatcctttgaagcctcaaaactactacgcccagtattatccttactaccagaacacgagacagtattatccttacaattttggatattattatcatcacagtttgccgaattcgcactactacaggcagcagt

SEQ ID NO: 167 - DNA, 500 bp, Ctenocephalides felis
  misc_feature (6)..(6): n = unknown at position 6
  misc_feature (8)..(8): n = unknown at position 8
  misc_feature (10)..(10): n = unknown at position 10
  misc_feature (14)..(14): n = unknown at position 14
  misc_feature (17)..(17): n = unknown at position 17
  misc_feature (35)..(37): n = unknown at positions 35, 36 and 37
  misc_feature (52)..(52): n = unknown at position 52
  misc_feature (56)..(56): n = unknown at position 56
  misc_feature (231)..(231): n = unknown at position 231
aggggngntntatnatnaatttttctttgacgacnnnggttaaggggggccncggncgggtattttttcataatcattcaatattaattattttattaattacaattttagtgggatatattatgagatctttattttataataaattatataatcgttatttacttgaaagacaaaatattgaaattatttgaacaattctacctgcatttatattaatttttattgctntaccttctcttcgacttttatatttattagatgattcaaataggcctttaatttctttaaaagcaattggtcatcaatgatattgaagttatgaatatactgattttaataatatttcttttgattcatatataattccatctaatgaattaaatttaaattcatttcgtttattagatgttgataatcgaattatcttacctattaattcacaaattcgtattttaattctgctaccgatgttcttcattcatgaaccattccctctc

SEQ ID NO: 168 - DNA, 498 bp, Ctenocephalides felis
  misc_feature (30)..(30): n = unknown at position 30
  misc_feature (57)..(58): n = unknown at positions 57 and 58
atatatcttacatcgaatctaataacattnaagagttattaattttcatgtcgatgnnttagaaaatgattcagtagcaacttctgaattttctttgtaatcgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggtacagatctactaatgccgcgtttaccactgtcacagcaattccgcaaaccagcaaccacaaatataaatatgatgctattgttaaatgttcaataaatgcacaaattattcc

SEQ ID NO: 169 - DNA, 232 bp, Ctenocephalides felis
tgtaaacagcactttgcctttgtaggttttatcgaaggcttcgctcaaggttttgatggctttggtgagttcagttttggctttgtcggtttcttcgggggatttgaaatttgttgctaagcggaagaagaataagctaggacgttcatcaggggttagttctaagactttgtcagataaaagcgttgaggacaccaggtctttcacaaacttctctggtaaatcactttgt

SEQ ID NO: 170 - DNA, 288 bp, Ctenocephalides felis
gataagaacagtggactctcgtgctcttgcacttctctatgttgaataggagcaccgcccaatttgtcatcaagttctacagtcataatggctgcggcacctgcctcatcttgtgacgtttccaatccaagccagaaatgaacatcccagctaaattggcccttcttgtcttctttagtattcaggatgatgtatgagtctcctgtgtagaattttccaaaatcatttttaggatacgcgacgggttcaaaattctctacacgccacacctccaagcctttggtagta

SEQ ID NO: 171 - DNA, 500 bp, Ctenocephalides felis
gttaattcccattaacacgcggcgtttttcgtttagcaattcaataaattacacacttcacaatggctgatatggaagatactcatttcgaaactggagactctggagcttcagcgacctatcccatgcaatgttctgcacttcgaaaaaatggttttgtaatgttaaaatcccgccccgtgtaaaattgtagaaatgtccacttccaaaactggtaaacatggtcatgctaaagttcacatggtcggaattgatattttcaacggcaagaaatatgaagatatatgcccatctactcacaacatggatgtcccacatgtaaaacgtgaagattatcagctcactgacattgatgacggttacttaacattgatggctgacaatggagaccttcgagaagatcttaaaattccagatggcgaattgggacagcaacttcgtaatgatttcgaatctggaaaggagcttttgtgcctgactaaaatcttgtggagaagaat

SEQ ID NO: 172 - DNA, 500 bp, Ctenocephalides felis
  misc_feature (5)..(5): n = unknown at position 5
gccgntgaagccgcaccagctccagctgcagcccccgccgccagcgaacgccaatcatccaggggatcccgcaaagccgtcaagcgcagtggatctaacgttttctccatgttctcacaaaagcaggtagctgaattcaaagaagccttccaactaattgaccacgacaaagatggtattcattggaaagaacgatctccgtgccactttcgacgaattgggccgtttggtacaagagaaagaactcgacgacatgatcggtgaggcttcaggaccaatcaacttcacccaattgttgaccttgttcgccaaccgcatgtctggatcaggtggtactgatgatgatgatgttgtcatcaacgccttcaagaccttcgacaacgacggcaaaatcgacagtgacaggttacgtcatgccctcatgacctggggagataaattcactgccaagaagttgatgacgcctacgaccaaatggcattgacgataaaggcttcatt

SEQ ID NO: 173 - DNA, 500 bp, Ctenocephalides felis
gatgccaaaacagaaccgtgtcgcaatctacgagcacctctttaaggagggagttatggtggccaagaaggactaccatgcaccaaaacacccagaattagagcaaattccaaacttgcaagttattaaggctttgcagtcgttgaaatctagaggatatgttactgaacaatttgcatggaggcatttctactggtatctgacaaatgaaggtattgaatacttgaggacatacttgcacttgcccccagagatcgtgccctccactctcaaacgtcaaaccaggcccgaattggcaaggccaagaccagctgccggcccaaggactgaaggatctcgtccagctgaagacagatctgcctaccgtagggcacctggtgcacctggtggcgctgacaagaaggctgatgtcggtgctggcactggagacttggaattcgtggtggatatggacgtggcagacctgccctcaataaatttatataagtaatttataataa

SEQ ID NO: 174 - DNA, 500 bp, Ctenocephalides felis
  misc_feature (4)..(6): n = unknown at positions 4, 5 and 6
  misc_feature (41)..(41): n = unknown at position 41
  misc_feature (61)..(61): n = unknown at position 61
  misc_feature (179)..(179): n = unknown at position 179
aggnnncacgcctatgctcaaaagaacttgcgcagatctgntcgtcgcattaaggaacttnccttccaagctgaagaagaccgcaagaaccacgaacgtatgcaagaccttgtagacaaattacaacaaaagatcaagacttacaagaggcagatcgaagaagccgaagaaatcgccgncctcaatcttgccaaattcgcaaggctcaacaagaattggaagaggctgaagaacgcgctgacttggctgaacaagccgtcagcaaattccgcgcgaagggacgtggtggatccatggcacgaggtggcagcccagtgcccgcaagaacagcagctcgcccacaatttgacggaatggctttcccgctaggttcgacttgaaccctgacagcgagttctaaattatttataattaattttaaaaaagcgaacgtggctgcttgacagtaaacattaatattttttaaaaattattaaaagtaaaaaatatcagctcgttca

SEQ ID NO: 175 - DNA, 500 bp, Ctenocephalides felis
  misc_feature (489)..(489): n = unknown at position 489
gtaaaaacaaaataaaatcattttagtttgagttagaacatgtgttattataagttagcgtaacacacaaaaattaatcataaatgtctgataataattggtagtatacttgtacagtaaattctttattttccttttcccaatctttttctaaaagcgagtgtggtcatactgctgtggtaattcgtcaccgagaagcggatgaagtttatcctccatcattagtgaaggctttgcttgtcagaagagagaggagtgttggttgccggtgtttattgtagttttaatttaattttaaactaagttatgcgtatgacccaagacatggacgatgatgaaaagggaaagcttttcgtcggagggctatcatgggagactactcaggagaacctgcagaggttcttctcgaggtacggcgaagtgatcgattgcgtcgcatgaagaacagcgagtcggcaggtcgcgcggcttcggcttcgtcacatttgncgatccctcga

SEQ ID NO: 176 - DNA, 500 bp, Ctenocephalides felis
aagccgtggtagtttcgctgtatgaggaacctattcagcctcaacaagctgcttctgtcgtggagaaacttggtgactacctcataacttgcggctactaaatgtgaaacactggagtggccccttattaatttttaagaaaactataataattataattacgattaatgaataaatttaaacaatgaagaccggccagcaaaaagggacagaatttttttctcatgcctcctgcaatgcagtaaaatattttgtgccatttttgtgcctttgttcccggtgacctttttttcctcagaagggacacctggagtgtactggcaaaatcgaggacattagtttaaacatttgtattataaaaccgtgcggacggcaaaatgaataaaaaatcttactacgattaaatttgtattaatttcgatgtgaggttatcgacttgtggatttaaatatactttctcctttaataaaactcgtgcttttgcaatttatgatttgcta

SEQ ID NO: 177 - DNA, 500 bp, Ctenocephalides felis
atcaacttggattttgtcggttaattccgaaatcgaaaaagtttttaagtgcaaaacatttaactgtgacatcagtttgtaatgtatctgggaaggaaatgagatctgtaaatccgattgaaaggtttcctccttatgactataagaagaaaggatacggatttatcaatgcgttttttgattacacaactaagagattcaatgataacacaaaggttattacagtggaaggtccaccagctgttggcaaaactgcatttgctaaagctttggccgaagatttagatatgaaatactttccagctgttactatggatcactactatattaatgaatatgggtatgatctcagacaacttgatgataaattacctgaatcatgtaaaagcatcgattttgataaatttcataaagatccgcataatagaaatgtagcaacaatgcaaattgtgttatatatgaaaaaatatgaacaatatcttgcggctcttgccatttat

SEQ ID NO: 178 - DNA, 500 bp, Ctenocephalides felis
  misc_feature (492)..(492): n = unknown at position 492
gtcattcactttttacgagttctttagtgtcctaatttattaataagtatcagaatggtgccgaaaacaaaagtatttgttggaagcttgccgccaggctccaagcctgaagaattacgtcgtttgttcgaagcttacggtgttgtaacagaatgtgatattatgaatcgttgtggctttgtacatatgcagaccgaagagatggcttttagcgcgattcaagcgttgaataatactacatttaatggggccacgataagtgtcgaaaggggccgcatcaaggaacgcggatcaggtggtggtcgtggaggcggtggccgcggcggtcgaggatttggaggacgaggaggtggtatgaatcgtagtggtggaggacctgggggtatgcgtaatggtggtggccccatgggaggtggcatgcgtcgtggaggcggtggcccaggacccatgcgtggtggtggccgtgacatgaatcgtggacaccctattctngtgatggt

SEQ ID NO: 179 - DNA, 500 bp, Ctenocephalides felis
atttgaatcctcttatcgattactaatcttttgtacagtttaatatttattatcaaggccttgtacgccagtgtgtgtaaaggtctcttcagtcgacgacagaggatagaagtcagaggacatttataatacgcagtttttaagttttttctggtgaatttgaatatatttgaagaaaatgaagaggtttttggttgctttggcggttttggtggtcgttgctgaggctaagctgtcatgttcgagtacaaaagcctcgatccccgaagaatggatcgacatgacagcccagtgcacgaggagcatgaggaaccagatccaagaagaactgagcgcttcgatgcaatacttggccatgggggcgcatttctcaagagacactgtcaacaggccaggatttgctgagatgttcttcaaatcggcaagcgaagagagggaacatgccatgaaactcatgtcttacttgatgatgagaggagaactgccgagaggctgcagga

SEQ ID NO: 180 - DNA, 500 bp, Ctenocephalides felis
aagaagatcaagaagaagaaggcaaaagaagagtctggagatgccccagccgctgaagccgcaccagctccagctgcagcccccgccgccagcgaacgccaatcatccaggggatcccgcaaagccgtcaagcgcagcggatctaacgttttctccatgttctcacaaaagcaggtagctgaattcaaagaagccttccagctaattgaccacgacaaagatggtatcattggaaagaacgatcttcgtgccactttcgacgaattgggccgtttggtacaagagaaagaactcgacgacatgatcggtgaggcctcaggaccaatcaacttcacccaattgttgaccttgttcgccaaccgcatgtctggatcaggtggtactgatgatgatgatgttgtcatcaacgccttcaagaccttcgacaacgacggcaaaatcgacagtgacaggttacgtcatgccctcatgactggggagataaattcactgccaagaag

SEQ ID NO: 181 - DNA, 500 bp, Ctenocephalides felis
  misc_feature (5)..(6): n = unknown at positions 5 and 6
acttnnctccatgcaagcctctcttgaagccgaagccaagggcaaggctgaggctttacgcatgaagaagaagttggaagccgacatcaacgagcttgaaattgctctggaccatgctaacaaggctaacgccgaggcccagaagaacatcaagcgttaccaacaacaacttaaggatgtacaaaccgccttgaggaagaacaacgtgcacgtgatgatgcccgtgaacaacttggcatttctgaacgccgtgccaatgctctccaaaacgaattggaagaatcccgtaccttattggagcaagccgacagaggccgccgccaagccgaacaagaattgggagatgctcacgagcaattgaacgaactttccgcacaaaacgcttcagtatctgctgcaagaggaaattggaatccgaattgcaaaccttgcattctgacttggacgaactctcaatgaagccaagactcagaagaaaaagcaagaaggcatggttgacg

SEQ ID NO: 182 - DNA, 500 bp, Ctenocephalides felis
  misc_feature (5)..(5): n = unknown at position 5
  misc_feature (34)..(34): n = unknown at position 34
agacngctgtttttgtgttcaaaaagcagtaaantatagaaaaaaaaaacttattactagtgcacattaacaaaaataagcagaacaactattaaaaatatgttttccatgtcaaaccttttctaaaaaccattcaatgcatagaaatgtaatttttaaaatcaatagtatgattttttaaaatatttggttttataccaggagtggactactgaatttctgcagtgttgctatggctctcaatgatctagggtacaaagctgttggtatacgaatagactctggtgatttagcatatctctcagttctggccagagaaacatttgagaggatagcagagaaatacaacattccttggtttgcaagactcatgataattgcatcaaatgatatcaatgaagacacaatactcagtctcaatgaacagggacacaaaatagattgttttggaattgggacgcatttagttacatgtcaaaggcaccagcacttgttgtgtc

SEQ ID NO: 183 - DNA, 500 bp, Ctenocephalides felis
gtggttcaaagataatccaagatgggtaagggaaataatatgatccctaatgggcacttccacaaagattggcaacgttttgtgaaaacttggtttaaccagcccgcaaggaaaattcgaagacgtcaaaacaggattaaaaaagctcgtgccttgttccctcgtcctgctgctgggcccctcagaccaattgtgcattgccccacagtgcgataccacactaaggttcgagctggcagaggttttaccctcgaagaaatcaggggagcaggtttgaatgcaggatttgctcgctcgattggcattgcattagatgttagacgtcgtaataaatctgtagaatctttacaacagaatatacaaagattaaaggaatacagatctaaattgatcttgttcccaagaggtggaaagaaattgcataagggtgaagcaactgaagaggaatgcaaggttgcatctcaattagaaggcgtcgtgatgccaattaaacaaacttc

SEQ ID NO: 184 - DNA, 500 bp, Ctenocephalides felis
  misc_feature (4)..(5): n = unknown at positions 4 and 5
aatnntattctgaatactatgttcgattttagcgttttcccggcgagcttgatataatattaattgtttggagtaaaaacaacaaattttcgaggattaatttatacaaaaaataattaaaatgaaattagttaggtttcttatgaaattatcacacgaaacagtgtcgatagaattgaaaaatggaactcaagtaaatggaacaataactggcgtggatgttgccatgaatacgcatttgaaagctgtcaaaatgactattaaagatcgagatccagtatttcttgatactataagtttgagagggaataatattaggtactatattctcccagatagtttaccattggagacccttttgatagatgatacacccaaagccaaagctagaaagaaggaagcagctcgaggtggaatacgaggaaggggtcgtggtcgtggtggcccagaggcggtcgtggaggtggtaggggacgtggacgaagataataatatttttg

SEQ ID NO: 185 - DNA, 500 bp, Ctenocephalides felis
  misc_feature (5)..(5): n = unknown at position 5
gaatntgctactttacaagccgctattgaagcaatcagttcaatgaacatgtttgacctaggaggccaatttttaagagtgggacgtgctataacgccgccgaacgctcttatgggaccgacaactggatctatgatgccgactgctgctgctgttgccgcagctgccgccacagctaaaattcaagcgatggatgcagttgctagtaatgctgtcgctttggggctgccgagtttgagttcttcacctacaattccgttatcagtgccgacgatagcggtgccgcccatcgcaacgataacgccatcagctcccgttgctatatccggtgctgttaagttaccaggtgtcgtcataccgcgcaggtgtcgtcgtacctcaagtcatacagcctccaggaattgtgacgccgacatcgcaaccagttataattccagtatcagtattacctaattgtgaatcttctccgacgatgatatcaacaagctcacctgcacaca

SEQ ID NO: 186 - DNA, 500 bp, Ctenocephalides felis
  misc_feature (34)..(34): n = unknown at position 34
atttttgccaaacacgatcaatctcaagctattntcaacagacacaaggatgttttagccagatggcagcgtctcctgggagactcccgtgctcgcaagacccgtttgctggacatgcaagaacagttcagacagatcgaggaattatatttgacattcgcaaagaaggcatcagctttcaattcctggttcgagaatgccgaagaagatctcacagatcctgtcaggtgcaactcgattgaggaaatccgtgccctgagggaggctcatgcacagttccaggcttctttgtcgtctgcacaggctgattttgaagccctggcagcccttgatcgccaaatcaagacgttcaatgttggccgaatccttacacctggttcaccatggaggctctcgaagacacctggaggaacttgcagaagataattgctgaacgtgatactgaacttgctaaagaagctcaacgacaagacgaaaatgataaattgaggaaagagttt

SEQ ID NO: 187 - DNA, 500 bp, Ctenocephalides felis
  misc_feature (5)..(5): n = unknown at position 5
  misc_feature (473)..(473): n = unknown at position 473
caggnttccacaacttgtcattaatatctcggtctcttcactgagacggtaaaagaatttcaaaatgggttacttttattgtatatcacttttatgcctgttcactatagttagctgtaataccggattagatcctaaaggtccaaaagttactcatgaggtatactttgacatcagcattggtggtgaacctgcaggcccgtgttttgatcggccttttcgggggcactgtacccaaaacagttgaaaatttcgtagaattgtccaagaaacctaaaggtgaaggatacaaaggcagtaaattccacagggtcatcaaggacttcatgattcaaggtggtgacttcaccaggggagatggaactggaggccgtcaatttatggagaacgttttgctgatgaaaactttaagttgaagcattatggtgctggatggttgccatggcaaatgctggcaaagacctatggatctnaatttttatcctacaaaccctgctggt

SEQ ID NO: 188 - DNA, 549 bp, Ctenocephalides felis
  misc_feature (5)..(5): n = unknown at position 5
  misc_feature (525)..(525): n = unknown at position 525
atgtnttcgggcatttagtgttttgaagtatcgtggcataaagcagatttaagttaatctgcttcattcaatacacaacatggtagggaaacccaacaagatgtatgtttttaagcgagatggccgcaaggaagaaattcattttgataaaatcacttcaaggattcaaaagctatgttacggattgaacatggattttgtagaccctgtctcaataacattaaaagtcataaatggattatatactggagttacaactcaagaacttgataatctggccgcagaaactgctgctaccatgacaacaaatcatgctgattatgccgttcttgcagcacgaatagctgtttcaaacttgcacaaagaaacaaagaaacaattttcagatgtcatggatgatttgtcaatatgactaatgagtatactaaaaagagatcaccaatgatagcagattatcatcataaaataataatggataatgcagatcgcattaactctgctattatttatgatagagaattcagntacaattactttgggttcagacat

SEQ ID NO: 189 - DNA, 549 bp, Ctenocephalides felis
  misc_feature (532)..(532): n = unknown at position 532
gttatttgtgaaataaatttattataaaatgttagatctatttacaatatttagtaaagggggcatagtgctctggtgctttcagagcactagccacatatttgcaccatctgtaaatgcacttattagaagtgtcatattgcaggagcgatctggaaaaaatacctacgaccacgattccttaacattgcaatataaattagacaatgaatttgagctggtgtttgtggttgcctttcagaaaattttgcaactgtcatacgttgataaatttttaaatgatgtacatttagagtttagagataagtataagaatgacttacaaaataaaaggtattttcaagaatttgactttggtgcttgttataacagtattctgcgggcggctgaagaatggggtcggactcaggctaagttacctaaacaaatgcgttcttttgaagattctatgaaatctaaaaagacagttgcttcaatgattgaaagaaagggcgagggaaaaaaagaccccagaagaatggtaaacaaaaangcaaaaatggttggttt

SEQ ID NO: 190 - DNA, 387 bp, Ctenocephalides felis
  misc_feature (386)..(387): n = unknown at positions 386 and 387
gacgttctaagcacggtcggggacatgtgaaccctgtaagatgcacaaattgtgctcgatgtgtccctaaagacaaggctatcaagaagttcgtcattaggaacatcgtcgaagcagctgctgtacgtgatatcacggaggcttctgtttattccgcttacgtcttacctaagttgtacgctaagttacactactgcgtttcctgcgctattcactctaaggtagttcgcaatcgctctaaggaagatcgtcgcattaggactccaccagtgagatcattcccaagagataatcaaaggcaacaaaatgctccaagaaagtaaatgttcatattttaaataaaaaaaacgacaacttaaaaaaaaaaaaaaaaaaaaaaaaaaaann

SEQ ID NO: 191 - DNA, 549 bp, Ctenocephalides felis
  misc_feature (5)..(5): n = unknown at position 5
attgnttaaattaaactgttgtcatttaagctttaaattacacactgacaacggagaagtacagtttatttcgcaatcgttatgttaacgttttctcttacatgtatgaaagttatttagttataattaaaaatggctctgcaaagcttgaaaggtttttctaaattgttaaacaaatgttcgaatcgtgtttcatatttaactgtaagatgtgcatctcaatattatgacatagatgataacatatttggattaaatgaggatcaggttcagttgaggaagaccattttcgattttgcccagaaagaattagcacctaaagcagctgaaattgataaaaataatacctttaaagaactgagagagttctggagaaaattaggagacttgggaacattaggaataactgctccagcagaatacggtggaacagaaggcacatatttagatcatgttattattatggaagaattatcaagagcttcgggagctattgccctctcatatggagctcattctaatctagcaataaatcaaattcgaaggaat

SEQ ID NO: 192 - DNA, 549 bp, Ctenocephalides felis
gcttttaacgctcttataaaagaaattgttaaatctattgaaatccttattcatcggtgcctattttcggcttaaagatggttcaaaagaagcctaagaagaaggtcggaaagaaagtggcagccgcccctttggctgtgaagaagtctgaacccaaaaagttggttaatcctttgttcgagaagaggacaaggaactttggaatcggtcaggatatccagccaaccagagacttatccagatgcgtgagatggcccaaatacatcagaatccaacgccaaaagagcgttttgcagaagcgtttgaaggtccctccaccaatcaaccagttcacgcagactttggacaaacaaacagctacacagttgttcaagattttagaaaagtacaggccggagactgctattgctaaaaaggcacgtttgcaagcacgtgctgaagctaaagcccaagggaaggaagacacacctacaaaacgtccaaatgttgtacgttctggcacaaacactgtcacaaaacttgttgaacaaaagaaggccacttgttgtg

SEQ ID NO: 193 - DNA, 493 bp, Ctenocephalides felis
  misc_feature (395)..(395): n = unknown at position 395
  misc_feature (407)..(407): n = unknown at position 407
gctaatttaaaaaccatatacgcttttgcgcgagagatgcattccaaaaatataaataaacctatacaatatggtacagctggatttcggaccaaagctacagacttggactatgtcatgtttcgtatgggggttcttgcagctcttcgttcccgtgttaaaagcacagcagtaattggattaatgataactgcatcacataatcctgaagaagataatggtataaaactcgtagacccccatggtgagatgcttgaacaaagttgggaagagttagcaaccactttagttaacgttagtgattctgagttagaggctacagttgaaaaaattgtaaaagacttgaatatcgatcttaatttgaaggctaatgtgtttattggtatggatacaangtatagtacgtncccagtctttgcaaagctgctgttgatggagtattatctatttcgggggatctcccagagaattttggtattggtaccgactccca

SEQ ID NO: 194 - DNA, 482 bp, Ctenocephalides felis
  misc_feature (7)..(7): n = unknown at position 7
  misc_feature (36)..(36): n = unknown at position 36
ttttttnatagtgatgcatcctttatcattaggagntaatactaattatccaaacaatttgaacaagaatatttattggtttaatttcaaaaacattttgattttcatatattttatttatttcatttattggaggaatattaattctatttatttatataacaagaatttcaaatactgaatatttttctttaaatatttataaaactatttttattattttattattaacattaagaattattatttattataataaaaattttctattaatttttaacaataattccatatttaatgattttaattcaaacttacttatatataattttaatctaaataaattatataattttccaaataatttattaactattatattaattatttatttattaatttcattaatttgtgtagttaaaattacagatattttttatggtcctttacgaaaaaatttttaaaaaaaaaaaaaaaaaaaa

SEQ ID NO: 195 - DNA, 549 bp, Ctenocephalides felis
  misc_feature (5)..(6): n = unknown at positions 5 and 6
gttgnnacagatacgtagctgttaaatgtcattgcgttgctatttttgattatttcatcagtatttcaataaatccaacatatgtctcggcacacatcattataattaaattattagtttcatttccattaatttattttactggcgtcaatatgacggtatcaaacgacgaattagttgaatcttttaaagctttaggtttaagtgaacaaaaggcgaaagaaacgttaaaaaatacagttgttacgaaaaatttaacattagcattacatgaggtgaggggcattattttgccccaaggagctggttctttaatctattatgtggcaacaaaaatcaaaccacagattatagatcaattgcctgtacttgtaaaatatatatcaacatcaaaattagacacaacagttagagttgatgcggccttgcaatttatgttgtctcatttaaatggatatcaaatcgatgaatttgagaaggcttgtggaattggtgttgttgtacacctgaacaaattgaaaaagcagtaaatgaggctatgttggaaca

SEQ ID NO: 196 - DNA, 549 bp, Ctenocephalides felis
ctttagtatattcggatataatttctatgttttatcaaatatattgttaaaaatgttatagtgttattgtaaataattagtcattaataaaaaatggctacatatgaagaatttattcaacaaaatgaagatcgagacgggattaggcttacatggaacgtttggccttctagtaggatagaagccactagattagtagtcccgctagcatgtctttaccagcctttgaaagagaggcctgatttaccaccaattcaatatgatcctgtacaatgtacgagaaatacatgccgagcaattttaaatcctttatgccaagttgactatagagccaaattatgggtttgcaacttctgctttcagaggaatccgtttcctccacaatatgctgcaatttctgagcagcatcaaccagcagagttgattgcaagtttctctacaatagagtacaccatcacaagggcaccatgtatgcctccaatattttatatgtcatgggatacatgcatggatgatgaagaactgggtgctttaaaagctctttacaat

SEQ ID NO: 197 - DNA, 549 bp, Ctenocephalides felis
tttttattcgttttacaaatcagtctcaaacgataaacacaaagtgaacgttttaaaacaaacataaaactgtgcctaatcccattcagtgatcgaaaaaactatataaaaccagttcgatagtaataatacataatttacccagcaacgtgcactgtataacctacaaatcacgatttcgactgaatgaaattatggacgctgaagatttgaatcagttctacaacgggcgggagatgggtgcttggcctcccaatgttggcatccttgccatcgaactgacgtttccgtcgcaatatgtcgaccaggccgaactcgaggcattcgatggagtgtcagcaggaaaatacacaattggactcggccaagcaagaatgggcttctgtggtgaccgagaagatattaattcattgtgtttaacagttgttaaaaatttgatggaaagacatcaagtgccttatgatagaataggttatttgggagtaggcacagaaacccttctcgacaaatcaaaaagtgtaaaatctgtccttatgcaattattcgaac

SEQ ID NO: 198 - DNA, 549 bp, Ctenocephalides felis
  misc_feature (6)..(6): n = unknown at position 6
gttttntataaattaatatatcgttctcgttgttaccaaattatattatttaaattaagtgaaaaatatggccagtgttgtgaagcagttgccaagaatatccggctccaaagtagcgaaatgcatttcgagccgtaattattattcgtatgtaaatgagcctgcccaacaaatcaaagacaaagaaccgaaatgggttactgccgaagaagccgtaaaaattattaaatcagatgactgggtgtacgctcagggtgcggctgctaccccaatcaacttattaggtgcgatgactgcacatgggaagaagcaaggcctgaagaatgtgcgcgtctgccacatgcacactgaaggacctgcattatacgctcagcctgattgcgaagggatatttagatctgtatcattcttcatgggaggcaacgtacgtgcagctgtgaatgaaggacgaggcgatgcaattccaatcttcctatcagaaatacctcttctattccaaaagaaaattattcaacctgatgtagccatagttcatgtttctcctccaga

SEQ ID NO: 199 - DNA, 544 bp, Ctenocephalides felis
gcttttcgatgttgatgccaaaacagaaccgtgtcgcaatctacgagcacctctttaaggagggagttatggtggccaagaaggactaccatgcaccaaaacacccagaattagagcaaattccaaacttgcaagttattaaggctttgcagtcgttgaaatctagaggatatgttactgaacaatttgcatggaggcatttctactggtatctgacaaatgaaggtattgaatacttgaggacatacttgcacttgcccccagagatcgtgccctccactctcaaacgtcaaaccaggcccgaattggcaaggccaagaccagctgccggcccaaggactgaaggatctcgtccagctgaagacagatctgctaccgtagggcacctggtgcacctggtggcgctgacaagaaggctgatgtcggtgctggcactggagacttggaattccgtggtggatatggacgtggcagacctgccctcaataaatttatataaagtaatttataataaaatatcaataaaacatcttattgataaacc

SEQ ID NO: 200 - DNA, 549 bp, Ctenocephalides felis
  misc_feature (4)..(4): n = unknown at position 4
  misc_feature (6)..(6): n = unknown at position 6
tgantnttcctgttattgcattcaccaacactgattctccattgaaatttgttgatattgcaattccatgcaacactaagtccaaccattccgttggtttgatgtggtggctgttgtccagagaagtcttgagacttcgtggatcaattccccgtgagaagacttgggatgtcgtagttgatttgttcttctaccgtgatccagaggaagtagagaaagaggatcttgttcacaaggaagttgtggccaaagttgagactgctgttgctcatgatactgctgaagtatgggcaggagatgagccagccactcaattatggactgatgatgcacctgttgctgcagttccggctgtttaccctgctgctgccagccaagattgggccgagcaagtgcaagaagaatgggctgccaaccctaccccagctgctggtcaaactacttggggaagctccacacaagaatggtcataaatcaaatgatactttttgtattggataaatgaaataaatgaaaattaaaattaaaaaaaaaaaaaaaaaaaaaaaa

SEQ ID NO: 201 - DNA, 549 bp, Ctenocephalides felis
  misc_feature (4)..(4): n = unknown at position 4
  misc_feature (6)..(6): n = unknown at position 6
catntntgctttgtggaaggaaagtctaaaataagaatataaactatgccgggtaccgggacgttcaaattattcatcggaaatcttgacgaaaaaactcaagcgtcagatatacgtcctctgttcgagaaatacgggacggtcgtcgaatgcgatgttgtcaagaactttggttttgttcatatggagaccgaacagcaaggtcgggatgcaattcagaacctaaacggctacgtaataaacggcgaggccataaaatgcgaagccgccaagagccggagggcgccgtcaaccccgacgacaaagatattcgtcggaaatttgacagataaaactcgcgcgccggaggttcgcgaactgtttcaaaaattcggtacagtcgtcgaatgcgatatcgttcgtaactacggtttcgtgcacttggacgcgagcggtgacgtgaacgaggcgattcgggagctgaacggaatgatggtcgacgggcaacccatgaaagtgcaagtgtccacgagtcgcgtgcgccagaagccgggcattgggtgatcccga

SEQ ID NO: 202 - DNA, 549 bp, Ctenocephalides felis
  misc_feature (5)..(5): n = unknown at position 5
  misc_feature (174)..(174): n = unknown at position 174
  misc_feature (502)..(502): n = unknown at position 502
atttnagccaaccagcaagcagaaacattgcagactcaattaaatctaatgtcccagcaacgagatgaacttttggccaagatgagtgacactgaagacaaatataatagacaagttgctgctctaaccaatttgcaatgtgccttagaacaattccaaagagataaagatcangaaatccaccaatgcacagaaaggataagaaaccaattggaattggaacgacaggaacaaactgctttaaggaacgaaatccaatccctaaaaacgcaacttagtgaacaacaacaaggcctgatggctgcaggaagacttgccagtcaacttgaatcctcacaaacaactgtacaaaatctcagacaagaattgaaagagagccaagacaaatacgctgctctgaccgccaaagtggagtcttcaaaaaacaaccaagccgacaaaatcgagaagagcttgtaaaaacctaatgctcggtacatccagctggtcaacaaaacgacangcacaaatctaaaatatatagcagtctcgacttcaccagtcggatgc

SEQ ID NO: 203 - DNA, 1098 bp, Ctenocephalides felis
  misc_feature (511)..(511): n = unknown at position 511
  misc_feature (1060)..(1060): n = unknown at position 1060
tgtttatattccttcaaaatgtccgtacgtgtgcaattcgaaaacaacaatgaaatcggtgtttttagcaaactaacaaacgcttattgtctcgtagcgatcggcggatctgaaaacttttatagtgtcttcgaggctgaattggcagagactattccggttgtccatgctagcattgcagggtgtaggatcattggcaggttgactgtggggaataaaaatggtttattggtgccagcttcgacaactgacacagagttgcaacatataaggaattctttaccagaaagtgtaaaaatacaaagggttgaagaaagattatcagctttgggtaatgtgatagcttgtaatgattatgtagccctagtacatccagatcttgataaggaaactgaagaaatcctaacagatgtctaaatgttgaagtattccgcaaacagttgcagtaatgtcctagtaggctcatacacagttttaagtaaccaagggggcttagtgcccccaaaacatncatacaagacaagacgagcttcgtcatactcaagtccgtgtttatattccttcaaaatgtccgtacgtgtgcaattcgaaaacaacaatgaaatcggtgtttttagcaaactaacaaacgcttattgtctcgtagcgatcggcggatctgaaaacttttatagtgtcttcgaggctgaattggcagagactattccggttgtccatgctagcattgcagggtgtaggatcattggcaggttgactgtggggaataaaaatggtttattggtgccagcttcgacaactgacacagagttgcaacatataaggaattctttaccagaaagtgtaaaaatacaaagggttgaagaaagattatcagctttgggtaatgtgatagcttgtaatgattatgtagccctagtacatccagatcttgataaggaaactgaagaaatcctaacagatgtctaaatgttgaagtattccgcaaacagttgcagtaatgtcctagtaggctcatacacagttttaagtaaccaagggggcttagtgcccccaaaacatncatacaagacaagacgagcttcgtcatactcaagtccg

SEQ ID NO: 204 - DNA, 545 bp, Ctenocephalides felis
  misc_feature (4)..(5): n = unknown at positions 4 and 5
gacnncggtgatgacagaggccgggatggcgattggacatgtcctagttgttccaacaccaactttgcttggagaaatgcctgcaacaggtgtagtgaagaaagacctgatggtgcaggcggcggtgactccggccgaggtggtggccgtggaggcggccgcggcggtggtggtggaggtggtagttacggtaaccgcggaggtggtgatagagattctggtcgcggtggtgatagaggttttcgcggaggtggtggccgcggtggcggtggcggttatggaggtggccgcggaggcggtggtgatcgtaattctggaggaggtggctcaatgcgtggaggagatagaggacgagataggcaacgaccttattaaataattagcttgtaattttattcaccctcattttcacatcattcgtactcatattagatttattgatttttagaattatttatatgatttgtatgattcaatgtaacacaatattgtaaatcttatattaagatttaataatataaaataatagaaaaaaaaaaaaaaaa

SEQ ID NO: 205 - DNA, 532 bp, Ctenocephalides felis
  misc_feature (3)..(4): n = unknown at positions 3 and 4
cannatgccacgaggaaaatataccaatcacaaagggcgtaacaggcatttcacaaatccagaagagttagaggaacagagaaagcaagaagaacaaaaaaggcaatggcgtagggatcatggaaacgaatcaagttctgaggaagaggaagtagccaaaaaagctgcaggtgataagaagaaagccccagggctggaaagctctgattcagagagtgaatcggagactgaatcttcagaagatgagaaggataagaagaaaggtgtatctggattgatagaagtggaaaatcctaatcgtgttcaaaaaaaaaccaagaaactttctactttaaatgaaacattaactgatagcaaaccacaattgtcaagacgagaaagagaagaagttgagaagcagagagcgcaagcacattaccaaaagcttcatgcagaagcaaaactgtcaagcaagatctgtttagcaagacttgcatcattaaacacagcgtgaagaacagcttaaagaccgagttggaaaaaaaaaaaaaaa

SEQ ID NO: 206 - DNA, 454 bp, Ctenocephalides felis
  misc_feature (5)..(5): n = unknown at position 5
atttntgttggttaactcgagcagtaagaatatataaaaatggctgcagttggcaaagatttagaaaaaccaacagctgaggtgcctcaggtccatcgcatccgtataactttaacttcaagaaatgtacgttcattggagaaagtatgtaccgatttaataaatggagccaagaaacaaaagctccgtgtgaagggaccagttcgcatgccaaccaaaatcttgcgtattaccacacgtaaaacaccttgtggtgaaggttcaaaaacttgggatcgcttccaaatgagaatccacaaaagagtcatcgatctgcactctccatctgaaattgtgaagcaaatcacttccatcagtattgagccaggtgtagaggttgaagtaacaatcgctgatgcttaaattttgtaaattgatggaaataaatgacaaaacctaaaaaaaaaaaaaaaaa

SEQ ID NO: 207 - DNA, 549 bp, Ctenocephalides felis
  misc_feature (470)..(470): n = unknown at position 470
cactttgaggttttgatccttaaccatggtgaacggacgcatcccgtccgtcttttcgaagacatatgtaacccctcgtcgtccttatgaaaaggctcgtttggaccaagaattgaaaatcattggagaatatggtctccgtaacaagagggaagtatggcgtgtcaaatacactttggctaaaatccgtaaagctgcccgtgagttgctcacattggacgaaaaggatggcaaacgtctcttcgaaggtaatgctttattgcgtcgtttagtacgtattggagtgttggatgaatccagaatgaagctcgattacgtgttgggtttgaaaatagaagatttcttggaacgtcgtctgcaaacccaagttttcaaactgggattagccaaatcattcaccacgctcgtgttttgatccgcagagacacattcgtgttcgcaagcaagttgtaatattccctcttcattgngcgttggattacaaaaacacattgacttctccctcaaatcgccttcggtggtggtcgtcaggacgttaaagaggaagac

SEQ ID NO: 208 - DNA, 549 bp, Ctenocephalides felis
cggtaataagggttgtgatcaacgaatcaatgacgctgctcaatttaaggctgtacgagcagccatgtcagtcatcgaaatttctgaagaagaacaaatacaaatccttcgtgtcgtcgcagcagttttgcatttaggcaatgttggatttactgaaagcgaaggaaaagcagaaattttgaaacctgaagctgtgcaatacgccagcgagttattgggatgttcatgtgaagctttatccaaagcacttacacatcgaactatcgaaccaggccgagggttggcaaaggtcagttctcctttatcgcgagaaatggcaattcatgcaagagatgctttagcaaaggctgtttatgatagaatgttcacttggcttgtgtccaggctgaacgcttctttgcaaccggtcaaaaccaggagctattcggtatgggaatattggacatttacggatttgagatttccagaaaaatagttttgaacaatttgataaacttttgcaatgaaaaacttcacactcttatcgagctgcttgaaatagacaagaca

SEQ ID NO: 209 - DNA, 549 bp, Ctenocephalides felis
  misc_feature (34)..(34): n = unknown at position 34
  misc_feature (525)..(525): n = unknown at position 525
attttaataacatgacaaaaaattaaccctatantttgtttaagttattgtattaatataaattatttttatttaatttcattattaagaattataattggagctttaggtggattaaataattcctctttacaaaaaattattacttattcttcaattacacatattggctgaataattattgctttaataaataatgaaataaatttttgattttatttttttatttactttatcatttctttaattattacaataaattttaattttttaaaattattttatataaatcaaatattatctaattcaataaattatataacaaaaattactttaataataatatttttatcaataggaggtttacctccatttttaggattttttcctaaatgaattattattgaatctataattaatataaatataattttttattctattattataattttatgtactttattaatattatatattattacgatttgcttttctatttaatataaataattccaaattctngaaaattatataaaataaattttc

SEQ ID NO: 210 - DNA, 549 bp, Ctenocephalides felis
  misc_feature (4)..(4): n = unknown at position 4
  misc_feature (543)..(543): n = unknown at position 543
cttntaaaaattattaataattccttaattgatcttccttctccatcaaatatttcattattatgaaattttggttctttattaggactatgtttaattattcaattaattacaggattatttttagcaatgcattactgtgctaatattgatatcgcattttcatcagttagacatatttgtcgaaatgtaaaattatggttgattaattcgtaccattcatgcaaatggggcatcatttttctttatttgtatttacattcatattggacgaggaatttattattctagttacaaattacatgaaacttgatttattgggttattaattttatttttagtaataggaactgcttttataggatatgtattaccttgaggacaaatatcattttgaggagcaactgttattacaaacttaatttctgctattccatatattggaaattcaattgtcaatgattatgaggaggatttgcagtgataatgctctttaactcgattctttatgatcatttttattccatttattattctgtttgnaataat

SEQ ID NO: 211 - DNA, 549 bp, Ctenocephalides felis
  misc_feature (4)..(5): n = unknown at positions 4 and 5
  misc_feature (34)..(34): n = unknown at position 34
gacnntataacaaaccgagattatttttgaaatnaaaggtattaggaaaaattattgataataacataaaagtctaaatgcttttataatatgacagcaatgcgtactgcaatgaatgttgtgtatacagttttgtggattctattaatttcacaaggtacccaaagcgttgaattaacttttgaactaccggataatgcaaaagaatgcttttaccaagatattcaaaaaaatacaagcgtcaccttagagtttcaggtcgtcacgggcggtcagtatgatgttgatgtaacattagaaagcccaaataagcaaattatatatagtcaagtgaaaacccaatttgattcgcatcatttcactgcaccgataagtggtgtttacgttgcttgtttcagtaatgaattttccacgttctcacacaaattggttatatggactttcaagttggtgatgaacagctttacccggtgtcggggagcatgctacagtcttacccaacttgaatctttgccaagagattcatcgaagtttgccagtttctcaatt

SEQ ID NO: 212 - DNA, 439 bp, Ctenocephalides felis
  misc_feature (5)..(5): n = unknown at position 5
aaatncgttacgtggctgcgtatttgttggctgttttgggaggcaaagccgccccgacctccggagacatcgagaaaatcctgagctctgttggtattgaagccgatgctgaacgtttaaagaaagtcataagtgagctcaatggcaagagcatcgatgaactcattgaacaaggtcgggagaagctttcctccatgccagtaggtggtggtggtgcaccagctgcagctgctgctggcggcgcccctgcggctgctgaagaaaagaaagaagagaaaaaagaggccaaaaaggaagaatcagagtctgaggacgatatgggtttcggtctctttgactaaggaatacgtatgccttacgtataatgaaattataaatttaaatgtaacatatgcataagaaataaagtgatttcatttataaaaaaaaaaaaaaaaaa

SEQ ID NO: 213 - DNA, 549 bp, Ctenocephalides felis
gtttaagtgtattcaaatcaaataattccataaaactattctagaaaataatccaacacagttagataagatgaagtctttggtgctcttggccgttttggctgtaggttttgcaaatgctgaatattgttacgatgaaagtgttactgcttgttcatcgactgccaataaggaggatctccctcattgtaatgccctctactccggtttccacactgtggctgccgacttatcatcatacgttaaaagagaagtcctatactcctacgactacttgctgatgtctacacactttggaaactatgaaaagaatcgtgttggtttcgaaaaactcttcaaaggcctctccgacaagtcttgggaaaacgcaatcaatgtcatcaaatacatcaccaaacgtgggggcactgtcgacttccagactactcacaatgtcaacactactcgtgtagctgaaacatcagaattggaagttgccagggctttggagaatgagaaagtgctcgtaaggatgtcaggctattcacaaacgtgtatcaactccgacac

SEQ ID NO: 214 - DNA, 550 bp, Ctenocephalides felis
attttagaatataaagctttaattatatttttaattttatatttttgttttaattatataatatttgagaattatttttgtaatttttatattgtatttacagtatgtgaaggggttttaggcctttctattttagttgcaataattcgtactcatggtaatgattattttaaaagatttaatataatacaatgttaaaatttttaataataatattttttataatccctattattttattaaaaaattgttattgattggttcaaacaatattatttataatattatttatttatataattttaggaataaaaagaattataattgttaatattagattaaattttggttatgatattatatcttatagattgaatttattaaggatttgaattattattttaatattaatagcatcaattttaatttataaaaataattataattaaattatttttattattattaattttttattattaatattatttttaacttttagtcattaaattattttgattttattttttttgaagaagataattccgcc

SEQ ID NO: 215 - DNA, 550 bp, Ctenocephalides felis
ctattcggaaaacttttcctgccgtagggcccaaacctccgctaatttctagtgagtgactaaatttaatgtcgtggtaagtggtgcaacaatgcagattttcgtcaaaaccctcacgggtaaaaccataaccctagaggttgaagcttctgataccatcgaaaatgttaaagctaagattcaagataaagaaggaattcctccagatcagcaaaggttaatctttgcaggtaaacaattagaggatggcagaacattgtcagactataacattcaaaaagaatccaccttgcatttggtgctccgccttcgtggtggtgccaagaaacgcaagaagaagaattattcaacaccaaaaaaaatcaaacataagaagaagaaggttaaactagctattttaaaatgttacaaggttgatgaaaatggtaaaatatttcgcatgaggcgtgaatgccccggagaggctgtggagcaggagtatttatggctgtatgacagataggcattctgtggaaggtggatcacttatttcagcaaaccagaagatatt

SEQ ID NO: 216 - DNA, 479 bp, Ctenocephalides felis
tagcacctcaaaacctgcttcggctaagagctcaacaactaaaccagctgctgccaaacctgcagctaagcctgctgctaaaccagcagctggtaagccaaaagctccagcaaaatctttgtctaagccaacaagtgctcctaagaaagttactaaagttgcggctaagcccaaagttgctgccaaaccaaaacgcaatgtttctgttaaaggacagaaaggagccaagcctgcagctaaagcagcagtcaagaaagctttaagtgtgcaaaagaaggtaattaaaggtgtaaatggcacacgcacaaggaaaatccgtacctctgtacactttaggaggcccaagaccctcaggccaccaagaaatcccaaatccccaggaagagtgtaccatctagaactcgcatggtgcttacaatattatcaaattccattgccactgagcagcatgaaaaaaattgagatccaatacttagtgt

SEQ ID NO: 217 - DNA, 420 bp, Ctenocephalides felis
  misc_feature (386)..(386): n = unknown at position 386
  misc_feature (404)..(404): n = unknown at position 404
cacaaatagggattaaaaaatggctccaagaaaaaacaaagtagcaaaagaagaagtgcaggtggctttgggacctcaagttcgtgaaggtgaaattgtttttggagtcgctcacatttttgccagcttcaatgatactttcgttcatgtcaccgatttgtctggacgtgaaactattgccagggtcactggaggcatgaaagtaaaggctgatcgtgatgaagcctctccttatgctgctatgttggccgctcaggatgtggctgagaaatgcaagtccctcggcatcacagccctgcacatcaagctccgtgccaccggtggaaacaaaaccaagaccccaggaccaggtgctcaatccgctttgagagctttggccgttcttngatgaaaaatggacgcantgaagatgtgacaccc

SEQ ID NO: 218 - DNA, 549 bp, Ctenocephalides felis
  misc_feature (502)..(502): n = unknown at position 502
  misc_feature (541)..(541): n = unknown at position 541
gcagagtaggcaaagtgtgactggcacttgtcagcgtttgtcgttcccgagtgctagattaggttatttaggattgttggccgatattccatcatctgggtaggctaaaatcaaggatcggaaagacgatcgagacgaacaaccatacaaaaatattttttagaacaaaatcaataaaaatttcaaaatgttatctcggattctaaaacctcttttaaatggatctactagagcgttttcgactacaaacaagaataatgtcaaggttgcggttttgggagccgctggtggaattgggcaaccccttagtcttttattgaaacagtcccctttgatcagtcgcctgaatttgtatgatatccttggaacgattggtgtggcagctgacttaagtcacattgaaacacctgccaaagtatgtggttacaatggcaagaagttttgtgcaaggcttagaaggagtggatgtagtcgcatccagcagcagccctcgtaaacctgnatgactcgtgatgattggttgcatcatgcttcattgtgntgaataat

SEQ ID NO: 219 - DNA, 549 bp, Ctenocephalides felis
  misc_feature (444)..(444): n = unknown at position 444
  misc_feature (452)..(452): n = unknown at position 452
  misc_feature (521)..(521): n = unknown at position 521
  misc_feature (542)..(542): n = unknown at position 542
gcgacctgtacacgcggtgacaactattctgtgttcaatcgaaagttaacgcgcgtttaacaaaagtttttaaaaaaatccaataaggataactataaaataacgttttcagtgattcagttataaatattcgtttgtgcatttcatatcattatggctaacaacagagctgcaaaatccggtttcgccgctgaggcacaaagaaagataaatagcaaatacagcgatgaacttgcacaagaatgcttggaatgggtcaaaaccattactggagagcccgaaaatgttagcggcgatatggacaatttttacgaagtattgaaggacggcacactgttgtgcaaattagtgaactctctacaagctggttctgtaaagaaagtcaatgagagcaaaatggcttttaaatgcatggagaatataaatgctttcttggaagcggcnaagctatnggcgttcctgcgcaagaaactttcaaacggtgatctgtggaaagacaaaatcttaattctgtgcatttnctcaatcattagggcgaaagntggaata

SEQ ID NO: 220 - DNA, 301 bp, Ctenocephalides felis
  misc_feature (32)..(32): n = unknown at position 32
  misc_feature (68)..(68): n = unknown at position 68
  misc_feature (70)..(70): n = unknown at position 70
  misc_feature (84)..(84): n = unknown at position 84
  misc_feature (88)..(88): n = unknown at position 88
  misc_feature (226)..(226): n = unknown at position 226
  misc_feature (277)..(277): n = unknown at position 277
ctcatttattatttatttatttatattagttntgtgaggattatttgatatcaatcaatagttattgntnggagaaatggcgtncacnacgaaaacttcgaagtattcttacagatcgaccggcggaggaaacgctgatgtcagcatcgagtacagtgctgatctcagtgccctcaccagattggaggataaaattcgtcttttacacgatgacctcgaatccganagggaactccgtgccaggatcgagcgcgagaaggcagatttgagtgtacangtcattcaactgtcagaaaggtta

SEQ ID NO: 221 - DNA, 549 bp, Ctenocephalides felis
  misc_feature (374)..(374): n = unknown at position 374
  misc_feature (402)..(402): n = unknown at position 402
  misc_feature (417)..(417): n = unknown at position 417
  misc_feature (440)..(440): n = unknown at position 440
  misc_feature (443)..(443): n = unknown at position 443
  misc_feature (445)..(445): n = unknown at position 445
  misc_feature (532)..(532): n = unknown at position 532
attttcactggatacaaacgaggtctcaggaatcagcatgaaaacacagctctcttgaaggttgaaggttgtggtaccaaagccgatagctggttctatgttggtaaacgatgtgtatttgtgtacaaagctaagaacaagacctgcgtacccggcaaaccaaagaagggtaaatcaaaaagtacgcgctatttggggcaaagtaacacggccacatggatgctctggttgtgttcgtgctaagttccacagaaaccttccagcaaaagcaatgggtcatcgtgttcgtataatgctgttcccatccagaatataaggcataggattcatcttttgttataaattataaaataaaccctataaaaaaaattaanaaaaaaaaaaaaaaaaaaaaaaaacctngggggggggcccggncccaattcgccctatagggagtngtntncaattcactgccgtcgttttacacgtcgtgactgggaaaccctgcgttcccaacttaatcgccttgagacatccctttcccagctgngtaataacaaaaggccc

SEQ ID NO: 222 - DNA, 549 bp, Ctenocephalides felis
gcataccgacacctccatttggtgtggcaaaatcatcagctgaagcagctaaaatagctacggatttgaaaacaaatgacattgtactcaaagcacaagttttggctggtggtagagggaaaggccaattcaaatcgggcttgaaaggcggcgttcgaatggttacaacgccagagcaagcagaaaaaatatcttcaaaaatgatcaaccaaatattagtaactaagcaaacaggtgaaaagggtcggatatgtaattctgtcatggtcacagaaagaaagtttccccgacgagaatactatttggccgttatgatggagcgagctttttctggccctgtaattattgcttcatcacaaggaggagttaatatcgaagaagtagccgctgaagatccagaagcaataatttatgaaccaattgcataatgaagggaattacacatgaacagacaaaaaaattgttggcaattgacttgaagatcatgcagaattaccgcagaatttagagaaatgtatgattggttttaaagaaagatcctctattgaa

SEQ ID NO: 223 - DNA, 549 bp, Ctenocephalides felis
gcgctattgagtcgcacgaataatttaacaaattatatatttaagtggaaattagataaattaataggacaaaacgtagcagtaatttcatgctcttactccacaaaaggatcaaaagtgtatgaagatgcttcagaagctgttaaagatataccaaatggagcaaaattactagttggtggttttggtttatgtggaattccagagaatttaatcgctgctgtattaaaacatggtgtttctggattaactgttgtttccaacaatgcgggtgttgatacgtttggtctgggattactgttaaaagaaaaaaggatcaaacgcatgattgcttcatacgtgggtgaaaatgctgaatttgaaagacaatatttaagtggtgaacttgaagtagaattgactcctcaaggaacattagcagaaagaatccgagcaggaggagctggtattcctgttttttcacaccaaccgttatggacccttgtcatgaaggaggcgctccattaaatatggaaagaaaggagaggtagaaattagagtcacctagct

SEQ ID NO: 224 - DNA, 549 bp, Ctenocephalides felis
  misc_feature (538)..(538): n = unknown at position 538
  misc_feature (543)..(543): n = unknown at position 543
aaagtcttttatcaatagtcttttataaagcactttctaccaggatacaatttaaattacattctataaataaaaaagcttactattaaaatgaacataaataccagaatgccataagtgtcttttctctcttatatacataataacatttcaataaatatttgtataaaaataatatctgaaatatgtacataactaaattaataggcaaatctcatttcaggattatatcctaatttatccagactaggctggcatgcaaatttgatcattggtggaggaccacacataagcactagagtatcatcggaaggaggaaacaaatgttctgcaatcatgtctgagtttataaaaccagtgctatatttccaattgtctggtgggctatcaagagtataccataatttaaattgagttggatcatttttagcaatttcttccaatctatcacgcctaatatatccttttcagtctggttgcaatatcaaagcgattcagttgatctggggttttacaattcctcactaactgagcatgngtaantctgac

SEQ ID NO: 225 - DNA, 549 bp, Ctenocephalides felis
gccattttcagtttgaagtgtcagtgatataataataatcctaaagtgcaatgacatttttttatataagagatgtttcttacaaagttaaatttcaagttattctctcccaataactttaccttagcgataataaaaaaatattcgtgtttaacgtgccaaagtctaaccctactttcctctagctttacaaagcaagatgaatatagtttattaccaattagaaattattcacaaaatactaaaaacgaattagctcattgcaacattggcactataggtcatgtagatcatggcaaaacaacattgacagcagcaataacaaaaattttatcaaaaaatggttctgcaaaatacatatcttatgatgaaattgatcgagctcctgaggaaaaagccagagggattccatcaatgcagctcatgttgggtatagcactactaagagacattatgctcatacagactgccaggtcatgccgatttgtaaaaacatgatatcagggcttacaaatggtggaccatttagagtggtgcaacagaaggcaa

SEQ ID NO: 226 - DNA, 549 bp, Ctenocephalides felis
gaaaaaaaggctccaaaggatgcctccaaaaatcctatgagggaccttcacattaggaagttgtgccttaatatttgtgtgggagaatctggtgacaggctcactcgtgcagcaaaggtgttggaacagttaacaggtcaacagcctgttttctcaaaagctcgttataccgtcagatctttcggtatccgtcgtaatgaaaaaattgctgtccattgtacagtccgtggagctaaggccgaagaaattttggaacgaggtcttaaagtacgagaatatgagttgaggcgagacaacttctctggaactggaaactttggtttcggtattcaagaacacatcgatcttggaattaaatacgatccatccattggtatttatggtttggacttctacgttgtactcggacgaccaggtttcaatgttgccacagaagcgcaagactggcaaagtggtttccaacccgttgcgaaagaagatgctatgaaatggtccaacagaaatatgatggtatattttatagtaaaagtgagaagacattttctgtat

SEQ ID NO: 227 - DNA, 365 bp, Ctenocephalides felis
ctaaaccgaggcttcaaaactacgaaaataccttctggtaagccaggcggcgaaaagaaattcaaagtacgccccgctcgcgtaaagggaatccaaacaaaacataccaaatttgtccgtgatttggtaagagaagtcgttggacatgccccttacgagaaaagagctatggaattgttaaaggtttcaaaggataagagggccctcaaatttttgaaaagacgcttgggaacacatatcagagctaagaggaagcgtgaagaactttctaacatcttaacccaaatgcgtaaagcacatgctgctgctacacatactaagtagatatgaataaagctgtttaattgtaaaaaaaaaaaaaaaaa

SEQ ID NO: 228 - DNA, 549 bp, Ctenocephalides felis
ggacaatgaagcaaatcgtaacaaatcaatctgtgaagattccagaaggccttacggtcactgtgtcatcgagacaggtcactgtcaaggggcccaggggagtattaaaacgctccttcaaacatttagcagttgatattcgtatggtcaatcctagattattgaaagttgagaaatggtttggatcaaaaaaagctattgctgcagttaggactgtttgctctcacatcgaaaacatgttgaaaggtgtaactaaaggttatcaatacaaaatgcgtgccgtatatgctcactttcccattaattgtgtgaccacggaaaacaacacagttatcgaaatccgtaatttcttgggagagaaatacatcagacgggtaaagatggcccctggtgttacagtgatgaactcccccaaacaaaaggacgagctgatcttggaaggaaactcttggaagatgtatctaaatcagctgcattaatccacagtcgccctgtaaaaacaaggatatcagaagtcttggatggctttatgtgttgaaaactcagtgt

SEQ ID NO: 229 - DNA, 549 bp, Ctenocephalides felis
  misc_feature (548)..(548): n = unknown at position 548
gtctacattattttgtttcagtacgggttgaccaatcgctcatcaacgacgataaataaaacactattaactgcaaaacgcaagttgacgaatattttttaatttaaacttataaatagcatccactgaaatcattttgaataaatatttcacgatgtctatcaacgactgtgaagagaaacgagaaatcatcgaaaggaagttggaaattccggatttcgcgttgaagcatccccttcagcacacatggactttgtggtattttgaaaacgaccggcaaaagacatgggaagaaaatcaacgagaaatagtcagttttgctacaattgaagacttctggagtgtttatagccatataaagatggctagcgaattgcgtcaaggatgcgattattccttgttcaaaagcggcatcaggccaatgtgggaagatgacgccaataagcatggaggaagtgggccatcaccatggcaaaaagcagcgacaaatgatttggatagaattggtggcaccctctctgttaatcgtgaacttttgaaattccacna

SEQ ID NO: 230 - DNA, 549 bp, Ctenocephalides felis
cgctgaaatcatctcgcgataacgttttgaatgtgttttatatgaaaacagtggctatttatttactcgatatgtgtccacagtaaagtatttgtgatttattcaagtgttgtgtgctgatttagtttgttcaatagaacctaaaaaagaacaaggtttgtggtgtttgtgcttacaacgttttaggattttgaattcgtgactctacgtggataacgctagacttccaggcatagcacaatgccggaagagaccaaagtggaggcggatgcacctcatagtcctgccaagcaaaaacggtcatcaggtggaagaactgttttggctaaagtcgacctactagatggatcagttcttgatctccatattgaacgtaaagtgaaagcaaaggagctcctggataaaatatgtgaagctttaaatattttggaaaaagatttctttggcttatctcagtcaccatctgatccagagtctggctggatccagaaagacagtgctaagttcttaaatctgaccatgggtgtgcatcgagtaaatctcccccag

SEQ ID NO: 231 - DNA, 549 bp, Ctenocephalides felis
  misc_feature (33)..(33): n = unknown at position 33
  misc_feature (189)..(189): n = unknown at position 189
  misc_feature (451)..(451): n = unknown at position 451
  misc_feature (495)..(495): n = unknown at position 495
  misc_feature (547)..(547): n = unknown at position 547
aaggatttaattttagaaagtttatcttcaatnaattttaattttttaatttatttattattttattttagaattgggttgactgtatgttattcttttcgactaagaagaatattattttttaattcttttaattattttagtttaaattttttaaatgatgaatttaataaaataattaaaataagntttattttaataattttttctttatgttttggtaagattatgattaatttgattttttatattcctaatatattttttattagatttataataaaaattatagttataattatatcttattaggattatgagtagggttagaaattaggtattataaaattgggtataattattttaatagaaaaaaattagtattttttggaaatatatgatttttccagtaatttctgtgtttatatttataaaccgtaattatggaatnatttaataaagatggtgacaaggatgattagaattataggatcnaaaactattttaaatattcttattatctaaaaattttataattcaaataatnta

SEQ ID NO: 232 - DNA, 548 bp, Ctenocephalides felis
  misc_feature (531)..(531): n = unknown at position 531
tatgcccctcaacattcgaagagaatctgattcctacaaatttcaaaggcatagaagattttgtgcaagcaactgcccacggtaaagctcaagaagttttccaaaggctaagtgaacaaaatacaccacccgatgttgttataggggctgatacaatggtcactttagacggtatgctttttggtaaacccaattctgaagaggactcttataacacactatcaaggttgtcgggaagagtttgtaccgtgtacacaggagttgtaatcaaaacacagcgcaaaacggtcaagttttgtgacaataccaaagtccattttggaaaactcactccggcagtgataagagcatatattgcatcaggagaacccatggacaaagctggaagctttggagtccaaggacgaggtgctagtcttattgaaaaaatggtggtgattattttacagttgtgggttacctctacataaattatgtgtcgagttaaattcttatgtgaaaatattaatatattataatgtgatattttgnaaatatattggttattt

SEQ ID NO: 233 - DNA, 549 bp, Ctenocephalides felis
  misc_feature (547)..(547): n = unknown at position 547
cttgtcatatattagtgaaaatgttattacaaataacgattgttttaagcactattggattagtttgtgacaggtgccacgggaatgaaatcattacccagtttgatgaagtaacagagtcagattttgcatttccagaagattttcaatttggttgtgctactgctgcgtttcaagttgaaggagcatggaatgaaagtgctcacttttgcttattaggaaagggagaaaatatctgggatagactgatacattccaagccagatttagtaaccgatcttacaaacgctgatgtcgcttgtgattcttatcacaaatttaaagaagatgtggctgcactcaaaactattggtgtcaatttttatcgtttttccatatcgtggtcacgagtgcttccactggtgacgcatccgtaattaacgaggaaggaatccaatattattctgatttaatagacgaattactaagaaacggattgaacccgtggtgactctattcactgggatgtcacagccttacagaattggaggtttataatccgtcatancc

SEQ ID NO: 234 - DNA, 549 bp, Ctenocephalides felis
attcttcacctgatttttttaaaatctaaagattttcaaaaaaaaattacgattttttctcgtgatgtttggcggggaaggggggtggtaattctgaatattacccaggggggatagaaggtccagaaatccttaaaaagttgatcacgttattaatggacaccccctaattgatgatacaaagatgagaatttacatatttctaatttctattaatcacgtgaggtttttagggggggaagggggtttatagtaagatatcacgtgtatttattttttacctgatttttttaaaaaactcaaattattttaaaaaaaatgaagatttttacgattttttcgtaactaaaaatacacctgatgtttgctggggcgatgaggggggaattttgaatattaccaagggagagggggttccagaaatccttaaaaaatttatcatgtgaccaatggcgcccccttaggattaatatgcagtaaaagttttttattcttatttatttaaaaaaatgccatgttgtggtcccaataaaaacgtacgatctattt

SEQ ID NO: 235 - DNA, 186 bp, Ctenocephalides felis
aatggacaaacaatttgttaccttcccgtcaatttgggtatgtagtcttaacaacgagtggtggtattatggatcatgaagaagctaggcgtaaacatttgggaggcaaaatattaggattcttcttttaagctgtattatgtcctgaataaatcagatttctacaacaaaaaaaaaaaaaaaaaa

SEQ ID NO: 236 - DNA, 343 bp, Ctenocephalides felis
  misc_feature (33)..(33): n = unknown at position 33
  misc_feature (39)..(39): n = unknown at position 39
  misc_feature (323)..(323): n = unknown at position 323
  misc_feature (325)..(325): n = unknown at position 325
  misc_feature (330)..(330): n = unknown at position 330
  misc_feature (334)..(334): n = unknown at position 334
  misc_feature (340)..(340): n = unknown at position 340
aagaagttgaaaagattgtcacaattatgtctnccccangacagttcaagattccagattggtttttgaatagacaaaaggatattgttgatggtagatacagtcaattgacctcatccaatttagactcaaaattgcgtgaagatttggaacgtatgaagaagatcaaggcacacagaggcatgcgtcactattggggtctgcgtgttcgtggtcaacacaccaagaccactggccgcagaggtcgtactgttggtgtgtctaagaagaaataagatacatatgtatttttttatttaataaattcttattctacaccatanantaaanaaanaaaaanaaa

SEQ ID NO: 237 - DNA, 549 bp, Ctenocephalides felis
  misc_feature (421)..(421): n = unknown at position 421
aaacatgtcacactaagtcatcgtatgaaacgtgttccaagaactgtttttcccaaaaatatgaccatggtcgtaaaagaagttactgaaatacttgaagatggtgccaagtttgaagatggttcaatagagaaattcgacattattttatattgcacgggatatctatatagttttccgttccttagtcctgagtgtggaattaccgtatctgaaaattatgtccagccattatataaacatttagttaatatcgaacgtccaacaatggcactaataggcattcctttttacgtttgtgcagctcaaatgtttgatttgcagattcggtttgtagttgagtatttgtgtggcaaatttcaattgccgtctaaagaagaaatgagagcggatactgaacgcgacatgcaaaaacgatggncacgtggggatagcaaaaggaaagcccatattatgggcccagatcaggaggcctattacaatgatttagcactactgtggatactcaattcccagtatgctaaatccaatgtgtagcgaagattcttg

SEQ ID NO: 238 - DNA, 549 bp, Ctenocephalides felis
ggaggtggtactggatctggtatgggtactctacttatttctaaaatcagagaggaatacccagacagaattatgaatacttattcagtagtaccttcacctaaagtgtcagacactgtagtagaaccttataatgccactttgtctgttcatcaattagttgaaaacacagatgaaacctattgtatcgataatgaagctctctacgatatctgcttcagaactttgaaactcaccacacctacatatggagatcttaatcatttagtttctttaacaatgtctggagtcactacttgccttagatttcctggacaattgaatgcagatttgaggaaattggctgtgaacatggtacctttccctcgtttgcacttcttcatgcctggatttgcaccactcacatctaggggaagccaacaatacagagcactcaccgtccagaattaacacaacaaatgtttgatgccaagaacatgatggtgatgcgatccccgcatggtcgtacttgctgtggcactggttcagaggcgcatgcatgaaagaagt

SEQ ID NO: 239 - DNA, 549 bp, Ctenocephalides felis
  misc_feature (537)..(537): n = unknown at position 537
gtggcccaggacccatgcgaggtggtggccgtgacatgaatcgtggagcaccctattctcgtgatggtggtcgtggaggagattttggtggacgaggtgctgggcccatgcgcaatggtatgggcggcggcggcatgggtggtggttatggtgaccgcggcggttctatgatggacggcggcatgggaatgcgtggtaatggcgttggagcaggtggaatgatggaccgcagaggtggcggcatgggaggcggaatgggcggcggtggcggttacccggatggcggattttctggtgaggacagacgcgggttcgcgctgccgcagcttggcggcggcggtgcgggcggcgcttacagagacttagacttaggtcaaggtggttatgataacatgtacatggatgaccgaagaggtggagcaccaccgatgatggatgataggcgaggcctgcaggtccaatgcgtcaccaatgcccatcccccaatgtttgacaggaggcgctgtgtccaggagcatggtggtggacccgtgattntcacaaaattct

SEQ ID NO: 240 - DNA, 549 bp, Ctenocephalides felis
tctcattgtcgatctcattactccacgatactccgtacaggagacactttacatagaaattaagtgcgtggtgaaatcattcaatcgaccattaaatttaagttaagttcagttttttatcaagttatttaagtgacagttaagtgccgtttttcgatccatgttctgtgcaaaaacgacaggatgacgttgaacgacgaaacagcaacggatgccatcgttaacggcgatggccttgaccgagacacgggagggctggaaaaggaccctaacacaaggaagaaaatggagttatcgctgcatgaacgcgatagagttggggtgcaagattctgttcttttagaagactacacaaatgaatcagttttcgtcgataatcttaagaagagatttggagaagaccttatatatacatacatcggcaagtactggtatccatcaacccttacaaagaactaaatatatacagagaaaagatgttttgaatatcaaagaagcgttttccagcctacctacgtattgcggtgagatatgcattagatcactgct

SEQ ID NO: 241 - DNA, 549 bp, Ctenocephalides felis
  misc_feature (521)..(521): n = unknown at position 521
  misc_feature (547)..(547): n = unknown at position 547
cttaaggccaaggctgagaaggagaaggcccaatacttcggtgaattgaatgaacttcgctccggagttgaccaccttgctaacgagaaggccgcacaagaaaagattgccaagcaattgcaacacagcctcaacgaagtacaaggcaaattggatgaaaccaaccgcaccctcaatgacttcgactccgccaagaagaagttgtccattgaaaactccgacctcttgcgccaattggaagaagccgaatcacaagtttcacaattatctaagatcaaggtgtcattgaccacccaattggaagacaccaaacgcttggctgatgaagaaagccgcgaacgtgctacacttttgggcaaattccgtaacttggaacacgacctcgacaccgtccgcgaacaagttgaagaggaagctgaaggcaaggccgtttgcaacgccaactcagcaaggctacgccgaagctaattgtggcgctccaaatccaatctgaggagtcgccgtctgagactcgaaaagcnaagtaattgcagccgtctgttaactnaa

SEQ ID NO: 242 - DNA, 426 bp, Ctenocephalides felis
  misc_feature (3)..(3): n = unknown at position 3
aantggtgcagcgtttagtataccgacgacgtttgtcgtacaacacaaaatctaacaggaggagggttgtccgaactccaggtggtaaactagtgtatcaatatttgaagaaacccaagaagatccccaggtgtggacaatgcaaagacaaactcagaggcatccagcctgccaggcccatggaaaggtccagaatgtgcagaagaaagaagacagtacgtagatcatatggtggagtactctgccacaagtgtgtaaaagaacgtattgtcagggcttttctaattgaagaacagaaaatagtcgtaaaagttcttaaagcacaacaagcaagtgttaaagcggctaagaaggataaatagacctaattctatgttaaatataacataataaaaactttctcaaataaaaaaaaaaaaaaaaaaa

SEQ ID NO: 243 - DNA, 485 bp, Ctenocephalides felis
  misc_feature (436)..(436): n = unknown at position 436
aatccaacgctttgcaatcgaatttatttagcatatcaggagattcttggcaaaaattaagaaatgctctgtcaccggcatttacatcgggaaaacttaaagctatgatggagattattattagatgcggtaaaaatttgcaagaatttcttgaagaaaaatccaacagtaaagaagaactcgaattcaaagacttggctgcaagatacacaacagatgtaatttcttcagtagctttaggcaatgaagtaaactcagtgaaaaatccaaatcacgaatttcgcgaaattggcagaaaaatatttaatttacccacaagatgggatgttgcatgtcattatgtttttcatgtcacctgaaatcctgaataaatttaaattggcaaatataagtcgtgaagtttatgatttcatgatgaatgtgtagacaaacagtncctttagagaagaaaataatatacagacctgttcatgcacttttgatca

SEQ ID NO: 244 - DNA, 549 bp, Ctenocephalides felis
  misc_feature (531)..(531): n = unknown at position 531
atattcttcacaattattgcagcgattcatttcacaggacacagggtgccgtatgattttgtaaataaaattgtaccattattaccagggtctaccacaggctggcagctaacaggatgtgccataatggcactttgtctatggttaactataattttcgttttaagatacacatttaaattgttactgatgtacaaaggatggatgtatgaggccagagggaaagggacttctgtttcgttaccgacaaagatttggcttgtgctagtcaaaatcatgtccggttggaacaaaccaggattgtacagttatcaaggatcactgccaagactgcctttaccatcggttgaagacacaaccaaaagatatcttagaagtgtccgtcccttattggatgatgccagttacaagcgcatggaaggtctgactgaagaattcaaaaaaggcattgcagtgaaactgcaaagatatctcttctgaaatctgtggcgagcactatgtctcagatggtgggaggattgttattgaganggagaggaccttatggtg

SEQ ID NO: 245 - DNA, 549 bp, Ctenocephalides felis
  misc_feature (498)..(498): n = unknown at position 498
  misc_feature (533)..(533): n = unknown at position 533
  misc_feature (543)..(543): n = unknown at position 543
  misc_feature (546)..(546): n = unknown at position 546
attttatcgatttgcttgttttcgtgtgcatttttgacgtttcatatttttcgaaaacgcccataagtattaaaacttaaaatggccagttacagtgaagatcaattggcagagttccaagaagcctttcaactatttgattctcggggtgatggtaaaatagatgttagcttggttggagatgctttgagagctcttggtcaaaatcctactgaaactgaagtcaaaaagttcacccatcaacttaaacatgatgaccgcatttcttttgaagtatttctacccatatatcaggctatctcaaaagggcgctcagcagatacggctgaagattttattgaaggtttgaggcactttgataaagatgggaacggttttataagttgtgccgaattaagacatttgctttgtactttgggggaaaaacttactgtgaggaggtcgagcaattgcttcaaaaccaagaagatctcaagcaacatcaattatgaagattgnaagaatggcatgtccggtgaatcataaattgaagntttaataacntcntca

SEQ ID NO: 246 - DNA, 549 bp, Ctenocephalides felis
gctgatgatgctgatgtagatatggttgtaagagcagcagtatttgcctgcgttggaactgctggtcagaggtgcacaacaacccgacgattaatcgtacacgataaagtttacgatgaagtgatctcacgattgaagaaagctttcgctcaagttcttacaagaattggtgatccattggacaaagatactttatatggacctctacattctgaaaattctgttaatgaatacaagagaacgattgaagaagctaagaaattgggcggtaaaattgaatttggaggcaaggtggtagacaggcccggattcttcgtcgaacccacaattgtttctggattggcccatgatgcccctgtagttcgcagcgagtgctttgccccaattgtatacgccttgagagcctcttctgtccaggaggccttcaaatggaataatgaagttgaccagggattatcatccagtctcttcacccaaagtattagcacgttttcgattggataggccatgggtcagactgcggattggaacgtcaacattccacatcag

SEQ ID NO: 247 - DNA, 549 bp, Ctenocephalides felis
ccaaaatgaagttgaatgtgtcttacccggcaacgggatgccagaaattgttcgaaattgtggacgagcacaagcttcgtgtcttctatgaaaaacgtatgggagcagaagtcgaggccgacatcctcggcgatgaatggaaaggttatgtactccgaattgcaggaggaaatgacaaacaagggttccccatgaaacagggtgtcttaactaatgttcgtgtacgtttgctgttgtcaaaggggcactcctgctaccgcccccgtcgtactggagaacgtaaacgtaaatctgtacgtggttgcattgttgacagcaacttgtctgttttagctcttgtcattgtacgcaaaggagtcaatgaaattcccggattgaccgacggcaatgtaccaagaaggcttggacccaagagggcttcaaaatccgtaagctgttcaacttgacaaggaagatgatgtacccgtatgtcgtcagacgtccacttccagtcaaagaaggtaagaacccgtacaaaggcccaagatccaaagctgtcactccacatct

SEQ ID NO: 248 - DNA, 549 bp, Ctenocephalides felis
attaaaaaaaaatctcaaatcgatcataaaagttttaatattaatttcagtaattaatacaacttctggatcagatgctaacaaatacgaagccacctgggagagtttggatagcagaccatctcccagttggtatgatgatgccaaagttggaatatttttacattggggagtttatgcagtaccaagttttggcacagaatggttttggcaaaattggcaaggatctaatgtgtcctcctacgtggattttatgaatcagaactatcgaccgggatttacatatcaagattttggtacagaatttactacggaactgtttgatccaaaccactgggctgagctattccaagcttctggggctaaatatgttgtgttaacaagcaaacatcacgaaggatacaccctgtggcatcaaagtactctttcagttggaactcccaggacgttggtgctcataaggatttaataggtttactaccaacgcaattcgcagcaaaaccaactacgtttcgtctctatcactcttgtcgatggtcacagacttat

SEQ ID NO: 249 - DNA, 550 bp, Ctenocephalides felis
  misc_feature (454)..(454): n = unknown at position 454
  misc_feature (519)..(519): n = unknown at position 519
  misc_feature (529)..(529): n = unknown at position 529
  misc_feature (535)..(535): n = unknown at position 535
gttatcaacaggattttggagatcgtgcaaggtgtttccaacctagtctaacttcttcatcttcaatatgtgatgaacgattcacttggaaccctgataatgagcaaagaatgattttacaagaagctctgtccaaagcacacactcatttaggcactggagcatcaataggttccggttccatttctggtagctccattggttcttcttctacgtcgtcttcctcatctagttcttcctcaagttcttcttcatggtctggcagcggaatgggagttagttcaactcaaggacaaaaggaaattgttcaaatcagcccacaaaaagtagggcttaaattaagaattaatgaagttcataaactaaatgtttattatgcacaagctgagattatccagtagattatattatttgatggacttgctaagtctatggaagatgataagagagatgncagcattggagattactctcagaacctgagaaatatactcaaattccggtgggtttggactttgnggataagtgngatgcntatgtgcaacatgcc

SEQ ID NO: 250 - DNA, 472 bp, Ctenocephalides felis
  misc_feature (440)..(440): n = unknown at position 440
gcaaataattctgtgttgatatatcttgtcatattaaaaacaagtgaacttgtgaaaatttgcaattaatttgggtgacaataatgagacttattatatttatatcgtgcttggcatcaagtacggtttaaatgtacctatagtcaaaggcataataaaaacgctagtggaatttgcaccaagtgttattgtataaaactgcaatatgatcaatataaaaagtatatgtccttatttttttgtttatattttactttcatcttatataaacactattttatgtatcccggtaccaatgaggcgctgtgcaaagttatacaactcaataagtcctcaagcctcggcagagtacgatgagaatggcgatatatcaaaagatctggtcgaaaatctcttacacaggtgtagaacaatgcacaagtaattttgtactcttgtgncggaaaatgaaacggtctctcatgtatgggca

SEQ ID NO: 251 - DNA, 339 bp, Ctenocephalides felis
  misc_feature (13)..(13): n = unknown at position 13
  misc_feature (54)..(54): n = unknown at position 54
  misc_feature (108)..(108): n = unknown at position 108
  misc_feature (139)..(139): n = unknown at position 139
  misc_feature (274)..(274): n = unknown at position 274
  misc_feature (305)..(305): n = unknown at position 305
  misc_feature (311)..(311): n = unknown at position 311
ggtcctaatttanttaccccattccaaaaattttaaatttttgccaaaaatgcntttctaccatggttaaagctcaaatatccggacttttttattgccttattattngatgaataatttcgattatttgatttcgatncaaaatctaaatgaaccagtttaaatccaaatcaaataattgaaattatttgtaacaaaaaaaaaatttataatcccaaaaatataaaaaatatttatttctactcattgaacacaaaattcacatagaaaatgngcctgtttgctatacaatatagattaaaatntacgtncgtattttaataatttttgcatatttat

SEQ ID NO: 252 - DNA, 549 bp, Ctenocephalides felis
ccggcagaccgtttttgtttgctgcattactcttgttggcgaaattagtgcacgatggctcaaccactagctacatctgatatcaagtataccaagctattcatcaacaatgaatttgtcgattctgtaagcggaaaaaaatttcctactattaatccaaccaatgaaaagaaaattatagatgtatcggaaggtgataaggccgatgtagatctggcagtcgctgctgccaaaaaagcgtttgcgctaaactcagcatggcgccagatggacgcatctgcacgcggaaagctacttaacaagtttgctgatttgattgaaagagatcttcaatatttagcaaatttagaaaccttagacaatggaaaaccattttctaatagtatcatagatatacagtgcgctatcaataccatcagatattatgcggctggtgcgacaaaattcatggtcatacaattcagcagattatggattgccagcttcacattcgacaccagtggtgtagtaggtcagatttaccttggacttccaatgctatggtgcctg

SEQ ID NO: 253 - DNA, 549 bp, Ctenocephalides felis
aacagctgtttgtgccgtacggtggtccccgcgtgtgtagcattgtagcagtatcaaagcgaagctcgatcgatccggtcgagacgtgaagcccgcgcgatacccccgcttcagagacaatttacagactccggagttaatatcacgaaaccactttgtgttcgacttctcagtacgacagtgtcggtcatttcaaacgcgcgttgtgtgtgtccatctatcatttacaacggggttcctgatttttcgaaggttcagtaataattttcgtatttcgttatggcgatgagatgtgtaggattgctcgtcaagagcaccatggtccagtccggacagcgcaggctgatatcccaatcagctgttgctatgaacaggatgcttcaggattcaccaaacgctcacctagataaatcaatcttgcaaaggtacactcgtcttctcaagacgatcggtcacgcaggtcacttacgtgtggatcgatggacggtgagtacttgccgctaaggacgtgtcttgaattaacctccaaaccagaaactgcaaatggac

SEQ ID NO: 254 - DNA, 549 bp, Ctenocephalides felis
gttgattatagtccttgacctttaactggagctttaggaactttaagtttaacattaggtataattatatgatttcatcaatttaattatacattaatattattaggaataataattaccttattaactatatttcaatgatgacgagatattagtcgagaaggatcattccaaggtcttcatagtttaatagtttctaaaggattacgaatcggaataattttatttattatttcagaaattttattctttttttctttcttctgagcatattttcatagaagattatcaccttctattgaattaggaataatttgccacctttaaatattaaaatatttaatccttttcaaatccctctattaaatacagcaattttattatcttcaggaatttcaattcatgagctcatcattcattactagaaaaaaatcattcagaaacaataaaaagttatttattcaattattttaggaattatttttctatacttcaatggatgaattttagaagctcttttcaattgagatcaattttggacaatttttc

SEQ ID NO: 255 - DNA, 465 bp, Ctenocephalides felis
gtttgtaacggcttccaaagatatgactgctaaactttttgacactgattcgcttttatgtttgaaatgttacaaaacagaaaggcatgtaaatagtgccgccatcagtcctattaaagaacatgttgcattgggaggtggtcaagatgctatggaagtaacaaccacatcctcaagacagggtatgtttgaaactagattcttccacttggtctatgaagaagaattcggtcgtgtgaagggacatttcggtccagtaaacagcttgaagttccatcctgatggaaagagttttgctacaggaggagaagatggttttgttcgagttcaaaattttgattatacatatttagattatgcttttgaataaacttgagaattttcatatttgtaatttgtccaatttatacaatgttcaagatgatgaaaataaagtataattatactgtaaaaaaaaaaaaaaaa

SEQ ID NO: 256 - DNA, 549 bp, Ctenocephalides felis
  misc_feature (3)..(4): n = unknown at positions 3 and 4
ttnnaccgtagctctaaagtgacgttacaatgtcgggaggcttggatgttcttgccctacgggaagatgatgttaccaaaatgttagccgcatgcacccatcttggcagcgaaaatgtgaacttccagatggagcaatatgtgtacaaacgccgtgctgatggagtacatgtaatcaacttacgtcgcacatgggagaagcttttgttggctgctcgtgctattgttgctattgagcatccagctgatgtcttcgttatttcctccagacctcaaggacaacgtgcagtattgaagttcgccaactatactggtgctactccaattgctggacgtttcactcctggtgccttcactaatcagattcaagctgcattccgtgaaccacgtttgctgattgttactgatcctcactccgatcaccaacccatcactgaggcttcatatgtgaacattcctgtattgcattcaccaacactgattctccattgaaatttgtgatattgaattcatgcaacacaagtccaaccatccgtggtttgatgtgtgg

SEQ ID NO: 257 - DNA, 549 bp, Ctenocephalides felis
  misc_feature (16)..(16): n = unknown
  misc_feature (45)..(45): n = unknown
  misc_feature (82)..(82): n = unknown
  misc_feature (95)..(96): n = unknown
  misc_feature (118)..(118): n = unknown
  misc_feature (128)..(128): n = unknown
  misc_feature (131)..(131): n = unknown
  misc_feature (176)..(176): n = unknown
  misc_feature (179)..(179): n = unknown
  misc_feature (201)..(201): n = unknown
  misc_feature (297)..(297): n = unknown
  misc_feature (388)..(388): n = unknown
  misc_feature (416)..(416): n = unknown
  misc_feature (437)..(437): n = unknown
  misc_feature (440)..(440): n = unknown
  misc_feature (459)..(459): n = unknown
  misc_feature (462)..(462): n = unknown
  misc_feature (472)..(472): n = unknown
  misc_feature (481)..(481): n = unknown
  misc_feature (524)..(524): n = unknown
  misc_feature (542)..(542): n = unknown
aatttgggacgagagnttattatttaaggataaggtaatttgcanggtcttaagcactattattttgataaaaatgaatganaagtcagaaaatnnatttcaaacccaatctgatttnaattaccttnctnttattgttggaataactgtagttttcgtcacattaattttattcnttntgtggcaaagaagaaaaggtgntcgaagggatatattgataactggacttagcgatgctgggaaaactttgttgtattcacagctggttcattcacagtcaaaagatactcatacttnaattgctgttaatgtcgatgaatacatcacaaagaatgcgtcagtaagagttgtggatatttctcccccccaaagattacgtggaagattnttgatgattacaaagattaaaacgaggnattgtgtttgttgttattcancantttggataaagacatttgngangtagctgagncttgacacnattctttctgaaaattagttacttctaatgtccacaagattgnacttgaatccctgtttgnatatggt

SEQ ID NO: 258 - DNA, 549 bp, Ctenocephalides felis
gtggtgttagccgcgactgtttcaactattttagcggcaagttgttcaaatccagaagttacagccacatctttcactacgcaagatgctacaattgttacaaatatagcatttattgctgaatttacattaaaatgcagtccaagtgttcctagtggcatacctttgtatgctgaaattgatggtaaagtaatgccgactgctagaattggagataataaataccaagttagctggactgaagaaattaacaaagctcgcagtggtgatcataaagtgagattatatgatgaagaaggttatactgcagttcgtaaagctatgcgatctggtgaagatgccagtgctgtcaggtcattggtgactatcgttatttcacatcctggtgcatttactggtccatgggtcaattctgaattggtgctcattagctgctgtggtgtagcttacttagcattacttcaaatacaaattattattatagatgatttaattatagtaatgtaaaatttattattaaatacaatctgattttataaaaaaaaaaaa

SEQ ID NO: 259 - DNA, 549 bp, Ctenocephalides felis
agatggttgtggtgatctgaatatttagtataaatttgtgtttttagcgttcatttatcagttaagtgatcaaaaatgtctttcaatcaagatattaaaacagaaaacggtggtgaattcgcccaagatgttgaaatgaaaactcacaatacagacggcagtggtgacgcatcaacaacacaaaatggacacgcgggaaagcctcgtttcgacgatagaaaattattcatcggtggactgagtgccgaaactaccgaacaacaattacgcgatcatttcgttcaatacggtgccatcgactccgtggatgtgaaaagcgacccaaataccggcagatcaaaaggattcgcatttttagtgttcgcgtccgtggactccattgaaaaagcgcttgcggtcagtgaacatgtcattaattctaagaaaatagacgttaagaaagcaaaagcgaaacacggaaagttttcgtcggcggttaaatacaacaataccgcgatgatattaaaactcatttcggcaatttggaaattcgcgagtcgactcccttgt

SEQ ID NO: 260 - DNA, 549 bp, Ctenocephalides felis
  misc_feature (473)..(473): n = unknown at position 473
  misc_feature (521)..(521): n = unknown at position 521
  misc_feature (526)..(526): n = unknown at position 526
gaaacttggcgcttattggagcacttcttcttgtacttgctgaatctcgagtggaaggaagaagtctttttgctggaattcctactatgggtgattcaaggccaaaaaattatttacaactggctggcagaattttactagctttcatgtttattacattaattcgttttgaattaagttttttacaggttatacaagatttaattggatctgttttaatggtattggtaaccattggttataaaacaaaattatcagctctgattttagttctacttctttcatttttaaatttataccacaatgcttggtggacagtgcctacctataagccattaagagattttctcaaatatgatttctttcaaacattgtctgtgattggaggtcttcttatgattgtttccttgggcccaggtggagtttcgatggatgaacataaaaaagagtggtagaaaaatcaggaatattgngccgtgtgctagtataacaattatatatatatatatatatatatatcntatcntatatatatatatatatatatat

SEQ ID NO: 261 - DNA, 549 bp, Ctenocephalides felis
cgtaaaatcaagaaacttctaagaaaattaatgtcactgttaaaacaccaaaagagaaacaaacagtggaagttgaggaagatgccgaaattaaagacttcaaaactttggttgctcagaaattcaacgcagaacctgagcaattatgtcttatttttgcgggaaagataatgaaggatactgatactttgaaaggtcacaatattaaggatggtcttactgtacatttagttatcaaaactcctccaaggcctgagccagaaagggcagctcagagacctccagctgatatcagtgcaacaccttttggattaaattcactaggaggtttagttggattagagtcattgggtttaggtcaaggttcattcatggatttacaagcacggatgcaaaatgaactcatgactaaccccgatatgttaagaaatgttttagataatccacttgttcagcagttgatgaatgatcctgaaaacatgagaccttaattacatctaatcctcaaatgcaagattaatgcacgcaatccagagattctccatgctc

SEQ ID NO: 262 - DNA, 502 bp, Ctenocephalides felis
gctgtacactcacgctctcgtgtacgtaaaaatactgaagccagaaggaaaggtcgccacagcggttttggtaaaagaaaaggtacagctaatgcccgtacaccacaaaaggatctatgggtacaacgtatgagagtcctgaggcgtttgttgaaaaaataccgtgaagcaaaaaagattgatcgccatttgtatcatgcactttacatgaaagcaaagggtaatgtattcaagaacaagagagttcttatggaatacatccataagaaaaaggctgaaaaggcacgtactaaaatgttgaatgaccaagctgaagctaggagaacaaaagtacgtgaagcacgtaaacgacgtgaagaaagaattgctactaaaaagcaagagctcttacaaacttacgctaaggaagatgaagcagcagccccaaaaaataaatgtcccttccttgtaaataaaataaatttatataaatttaaaaaaaaaaaaaaaaaaaaaaaaaaaa

SEQ ID NO: 263 - DNA, 549 bp, Ctenocephalides felis
  misc_feature (32)..(32): n = unknown at position 32
  misc_feature (512)..(512): n = unknown at position 512
ggttactatgcctttctcggttcgagaaggtnttaacatatttttggacggttatgtgccaactgaaaacatgagattcaggactgaatcgcttgtttttaaagtagccgaatcggcaaccgaggaagaggtgaaacgtatgaaccattacgtttacccggcaatgtcaaagacaatgggcgatttccatctggaaatcaaacagggccagttttcggattccgaaattttagtattattgggcgaaaacggtaccggtaaaacgacattcatcagaatgttggccggaaacttggaacctgatgcaggttctgcgaagttgccacaattacacataagttacaaaccgcagaagatttcaccgaaatctcaagggcacgtgaggcatttgttgcacgagaaaattagggacgcatatatacatccacagttcataacagacgtaatgaaacccatgaaaatcgaagaaatcatggccaagaagtccaaaacctctcggcggcgaactgcancgcgtcgcctcgtcttgctcggaaaccggccgcgtct

SEQ ID NO: 264 - DNA, 534 bp, Ctenocephalides felis
attcgtgaaaaatattaatttaaaaatgcagaaacaaaagagggaacctattcatgctgtccaagtttttggcagaaaaaagacagccaccgctgttgcctattgtaagcgtggacgtggaaatttgcgagtaaatggacgtcctttggaactcgtggagccaaaagttctccaatacaagttgcaggagcctattctacttttaggcaaggaaaaatttgccggtgttgatatccgcgttcgagtaaatggaggaggtcacgtcgcacaaatttacgctatcaggcaagcaatttcaaaggctttagtttcctattaccagaaatatgtcgatgaggcgtctaagaaggaaatcaaagacatgctgattcaatacgacaggaccctgttcgtagcagatccccgtcgttgcgaaccaaagaaatttggaggtcaggtgcccgtcacgttaccaaaagtcatccgtaatttatattatctttttttaaattctattataataaattggttgcagaaaaaaaaaaaaaaaaaaaa

SEQ ID NO: 265 - DNA, 549 bp, Ctenocephalides felis
  misc_feature (43)..(543): n = unknown at position 543
gtgaaaaggccattctcatcgatggtcgtggccatctgttaggccgactggctgctattattgcaaaagttttgttagaaggaacaaaagttgttgtagtaagatgtgaacaactgaatatttcaggaaacttcttcaggaacaagttgaagttcatgtccttcttgcgtaagagatgtaacatcaaccctgcacgaggaccttaccatttcagagcaccctccagaattttgtggaagactgttcgtggtatggtgccacacaagaccgaaaggggaaagcaagctcttcgcagacttaaggcatatgaaggttgcccagcaccattcgacagaaggaaacgtctagttgttccaaaagcaatgagagtcatgtgtcttaaacctgccgcaagtactgcatgttggtcgcttatcaaatgaggttggatggaaatatcaagatgttgtcgtactcttgaaaacaagaggagagttaagactattcttaacatcaaaaagagaaataatcttaagaactcctaagaaggaggtgagcagtcgncaaagg

SEQ ID NO: 266 - DNA, 549 bp, Ctenocephalides felis
gaaaaacaagcagtacttcaagcgctaccaagtaaaattcaaaaggcgtcgtgatggtaagaccgattactatgctcgtaagcgtcttacagtacaggacaaaaacaaatataacactcctaagtatcgactgatcgtgcgcctttcgaacaaagatatcacctgtcaagttgcttactccagaattgaaggagacaagattgtgtgcgctgcttattcacatgaattaccaaagtatggtatcaaagtaggtttaactaactacgctgcagcatattgcacaggcttgcttttggctcgaaggctcttacaaaagttcggcttggataatttatatggtggctgtactgaagtaacaggcgaagagtacaatgttgaagctctggatgatggaccagctgctttccgttgctacttagatgttggtttagcacgtacaaccactggtgctcgtgtgttcggagccatgaagggtgctgtgtggtggcttaaatattccacactccactaagcgtttccaggtatgatgctgaaagcaaaagctcatgc

SEQ ID NO: 267 - DNA, 514 bp, Ctenocephalides felis
ctgttaaaacatcaattacaatatgtcagacgtagaagttgatgtaccttcttcggccccagttcttgggggagccatggacgtaaacactgctttacaagaagtgttgaagactgcacttattcatgatggacttgtacatggtttacacgaagccaccaaatctctggacaaacgacaagcagttctttgtgttttggctgaaagttgcgatgaaccaatgtacaaaaaattagtacaagctctgtgcaatgagcatcagattccccttgttaaagttgatagcaacaaaaaactaggagaatgggcaggtctttgcaaaattgacaaagatggtaaagccagaaagattgttggatgctcatgcgttgtcatcagagatttcggggaagagactccagctttggatgttttgaaggactatttgaaacaatcgagttaaactatcttgctatttttaattatgaaataaaaatacaaaaacctaaaaaaaaaaaaaaaaaaaaaaaaaaaa

SEQ ID NO: 268 - DNA, 549 bp, Ctenocephalides felis
aattcggcaccagggtcggctttagtcgtaacaaattgaatatcaaaaaataatgataaatttatcattcagtcttattctaaaatcgtagacgtgatgttgttttggttagttttaatttttgtgttgtgtttttatgcctattttaggctaaatcgagtgcgacgatttgctgataagataccaggagaacaaccatggcctatagcaggaaacgccttagatattgggacggatcatacgaaattattacaaaaacttatgcaatatttggataagtataaattttctcgatttggtatttggcttgggatggactattttgtgtttttagtagaacctgatgatgttgagattattctaagcaacaccacaaatataaccaaatcaaaagaatatgattttctgcacaaatggcttggagctggttattaacatccacaggcgataaatggcgacatagcccgaaaaatcattaccccacattccactttaaaattttagaggaatatgcagaggtgatgaccgtgagtgtacttggttaaaaat

SEQ ID NO: 269 - DNA, 477 bp, Ctenocephalides felis
cttcttcctctgattggtaacaaaacaatttcttattgggacagttttgcaatcacaaaattagtgtttcagaaaaatgagagctaagtggcgtaaaaagaggatgcgcaggcttaaacgtaaacgcaggaagatgcgtgctcgttccaagtaaataaacgattgcaatcatttaacacttgtgtatatttttgcagtttattgtgaagctcattatcataatggccaaaatgaaatattttcgatattcaatcgacattcattatatttaagtaacaatagtatatgtatagcctgtttctaaattattatgcaagcataaactaaaaattatttattaaacaaatgttatttaatatattattgaattattatatatattgaattgaattgttataaacccgtattaatgaattattataaacccgtattatacagaaatatatatttattaattgcaaaaaaaaaaaaaaaaaa

SEQ ID NO: 270 - DNA, 549 bp, Ctenocephalides felis
  misc_feature (456)..(456): n = unknown at position 456
  misc_feature (495)..(495): n = unknown at position 495
agagtattctgtatctattaccatagtgttttgtttgtttaaatagtttttaaagataacaaaatgaacttaattatacttttcggcctgtgttttgttacgttttgtacgggacatgaggaaagcccttacacattccaatatacgaaagagaactttcaagagggagttggaaaaaataaccatttcatcatgttttatgcaccctggtgcggttactgccaaaaattggcgcccacatggaaccagttagccgaaatgttaaattcagatgagcattcaagagtcaccattgccaaagttgattgtacgactgacaatgaagtttgttctcaacatgatgttacaggctaccctactctgttatttttcaaattggacaccgaagaacctgtgaagttcaaaggaactcgagatttgccaactctcacagcttttattaatgaacaaattggngcaatgaacctttggatgttgaatcgattccacatattntgatgctgcaatggctagttgaaccgcagaagataggttggagatatgtcagag

SEQ ID NO: 271 - DNA, 549 bp, Ctenocephalides felis
  misc_feature (443)..(443): n = unknown at position 443
  misc_feature (543)..(543): n = unknown at position 543
gttagcccaaggtttaatagatcgtggccattttgataaagagaatataaaaattagacaagctgatattgaaaaacaatttgacaatttgaaaaacttgagtttacaaagggaaaaacggcttgctgagagcaagaaattcttccactttattcaaatggtagaagaggttcaggagtggataaatgatcagatatcaattgcagattctgaagattatggaactgatgttgaacatgtggaattgctcataaagacttttgatacttttgtagcaggattaatagctagtgaaagcagaattataaattgtacagacacaggaaagaaattgattaaagaaggaaatccatgcgctgatactattcgagataaaattgatgaaacaaaacaattatgggatgacttaaaagaattagctcatgttcggcaagaggcattgntggtgctaaacttgtcatgtgtttgccgcaatgctgatgaactatttcctgatagctgaaaagaatcgacataccactgccatacttcaagattagaagnatccat

SEQ ID NO: 272 - DNA, 515 bp, Ctenocephalides felis
  misc_feature (28)..(28): n = unknown at position 28
  misc_feature (145)..(145): n = unknown at position 145
  misc_feature (178)..(178): n = unknown at position 178
ttgcccttagtctaaaatggggcgtgtnatcagagctcaaagaaaaggtgcgggctccgtcttcgtggcccatacaaagaaaaggaaaggggcacctaaacttcgttcactcgatttcgctgagagacacggttatattaaaggngttgtcaaggatattatccatgaccctggtcgnggagctcccttagctatggttcacttccgtgatccatacaagttcaagaccagaaaagaattgttcattgcacctgagggtatgtacacaggacagtttgtgtactgcggtaaaaaagctaatctacaaataggaaatgtaatgccagttggtgctatgccagaaggaaccattgtatgcaacttagaggagaaaactggcgaccgaggtcggctacccgtgcttctggaaactacgctctgttattgctacaacccggcactaaaaagactcgtgtcaagcttcattggagctaaaaaggtatgcctttacatcgtgctatggtggattgggctgg

SEQ ID NO: 273 - DNA, 549 bp, Ctenocephalides felis
  misc_feature (488)..(488): n = unknown at position 488
aagcattctcatactttgcaacagctcaacaatggaaaaaaaattcctccaagcaattggaaatgtgagaaatgtgatctcacctcgaatttatggcttaatttatcagatggatccattttatgtggcagaaaattttttgatggcacaggaggaaatgatcatgctgttgaacactacaaagcctatggttatcctctggctgttaaattgggtacaataactaaagaaggtaaaggtgatgttttcagctacgatgaagatgatatggtagaggatgttaacttaaagcagcatctagcacattttggaatcaatataactgatttagaaaagactgaaaaatctatggtagaattggagcttgatttaaaccagcgagtaggggagtggggtgctcttactgaaagctcaaatgccttgaaacctgttatggcctggttatactggctgagaaatttgggaaattcatgttatttgaacagtgnatgcagtttgtcactatccagacttattcttagattgcatgatcacctagatatcacacat

SEQ ID NO: 274 - DNA, 406 bp, Ctenocephalides felis
  misc_feature (55)..(55): n = unknown at position 55
  misc_feature (349)..(350): n = unknown at positions 349 and 350
  misc_feature (352)..(352): n = unknown at position 352
  misc_feature (400)..(402): n = unknown at positions 400, 401 and 402
cgttagctaaagatttattgcatccgacgattgcggaggagaagagacgtcacangctaaagcgtcttgtgcagcatccaaattcttattttatggatgtcaaatgtccgggttgttataaaattacaacagtttttagccatgcacaaagtgtagttgtatgtgctggatgttcaacaatattatgccaaccaacaggaggtcgtgctcgtctgactgaaggatgttcgttcaggaggaaacaacattaatttaagttatttcctactttgtttataagatgtaaaagttaaattgccttgtagatttttttaaaactctaataaaggcaaatttgaaaaaaaaaaanngnaaaaaaaaaaaaaaaaaaaaaaaaaaaaaaaaaaaaaaaaaaaaaaannnaaaa

SEQ ID NO: 275 - DNA, 399 bp, Ctenocephalides felis
  misc_feature (353)..(353): n = unknown at position 353
  misc_feature (365)..(365): n = unknown at position 365
attacgcagaaccttctgcaaaaaatgcaaggttcacaagcaacacaaagtaacacaatataaaaaatcaaaagaacgacatgcagcccagggacgtcgtcgttacgacagaaaacaacaaggttttggtggtcagaccaaacctatcttcagaaaaaaggctaaaactactaagaaaattgtattgagaatggaatgctccgactgtaaattcaggaaacaaatcccacttaagcgttgcaagcacttcgagcttggtggtgacaagaagaggaagggacagatgattcagttctaaatgtgtattttttttacatacgactgtattaagtttaataaagcagtttaatgtnaaaaaaaaaaantaaaaaaaaaaaaaaaaaaaaaaaaaaaaaaaaa

SEQ ID NO: 276 - DNA, 549 bp, Ctenocephalides felis
  misc_feature (417)..(417): n = unknown at position 417
  misc_feature (516)..(516): n = unknown at position 516
gcttcagctcatttagtcggaggagcaaagaaggtcatcatttcagctcctagtgcagatgcaccaatgtttgtttgtggtgttaacttagaagcttatgacccgtccatgaaagttgtatctaatgcttcttgcactaccaattgtttagctcctttggctaaagttattcatgataactttgaaatcgttgaaggtcttatgactacagtccatgctaccacagccacccaaaagactgtggatgggcctagcggtaagttatggcgagatgggcgtggagctgcacaaaatattatacctgccgcaactggcgctgctaaggctgtaggcaaagtcattccggctttgaatggtaagcttactggtatggcgtttagagtccaatagcaaacgtttctgtggtgatcttactgnaagattgggtaaaaatgcacttatgaagatatcaagaacaaagtaaggagcatctgaaggctcttgcatggaatttggattatacagaagatgatgtgngtctgtgattcattggtgatccctctcgatctt

SEQ ID NO: 277 - DNA, 549 bp, Ctenocephalides felis
agttgccgccctcgtagtcgataatggatctggtatgtgcaaagccggtttcgctggggatgatgctccacgagctgtattcccatcaattgttgggcgcccccgtcatcaaggtgtgatggtcggcatgggacaaaaagacagttatgtaggtgatgaagcacaaagcaaaagaggtatcctcacattgaaatacccaattgaacacggtattgtcacaaactgggatgatatggaaaaaatctggcatcacaccttctacaatgaactccgagttgccccagaagaacaccctgttctcctcacagaagccccattgaatcctaaagcaaacagggaaaagatgacccaaattatgtttgaaaccttcaacactcctgcatgtacgttgcatccaggctgtctgtcattgtcgcttctggtcgtaccactggtattgcttggatttggtgatggtgttctcacactgaccaatctatgaaggatcgccctcctaccttcttgcgtttggacttgctgccgtgacttactgatattaatgaaatctaa

SEQ ID NO: 278 - DNA, 549 bp, Ctenocephalides felis
aatgaggtttgtacgataactattgtggcttttagttcaattttacagtagtataaaaaatgtctagtgtgtatgagaataaaaatggttttaaagatggatgtatcgacttcacggcaggatccttgggaggtgtggcattggtgctagtcggtcaacctttggataccgtaaaagtgaaaatgcaagctttcccaagtctttatagtggcatgacaaattgtataaaaaagacagttaaaagagatggatttattaaaggattatatgcaggaacaactccagctttaatagctaatgttgctgaaaattctgtattattcgctggctacggagcttgccaaaaattcattgcctacttgactggcgaaaaagatgtatctaaattaagtacttttagtaatgcatctgtggtgctcgctgcatttttttcatcattcacattatgtccaactgaattggtaaatgccactccaagccttggaggaagctcaaattcagaaggttcgctggcaaatgattgaagaatgggccgataaataaccaacg

SEQ ID NO: 279 - DNA, 549 bp, Ctenocephalides felis
agcggcttccaccttctttcgctattgtgtccgcaaagaatatgaaaataatatattacacatagtgcatgtagtttttctaatacatgatacacttataaaataaataataacaaacatttgaagttgatacaaaagtacatcaggttaaaatgccggaaggtgtagaaaatttagttctaggagaattatatacatcggagaagaatggtagtgatgaaacaggagatggaactgcagatcgccctttcaaaacaattcttcaagccatgaaacatgctggtaaggagccatttccaacgatatatgttgatgcaaaggaaccagagagtggtgagaaatatgaactcgctgccaaatctcaattgaagaaaatacaaaaaatatgggtgagagatacatataaaaatgcagataaattaaagaaagaggaagaggatgcaaagaaacgagaacagaatctgtggaagctaaaagattcaaatcaagaagacaaaattaccaccgtaagtataaaattaacaggtgattcatcgaattgccggttaa

SEQ ID NO: 280 - DNA, 528 bp, Ctenocephalides felis
cacgtgtgatttatttcttctgatttagttttgtgttgcaataaacattataatttaacctcaaaacttcaaaatgtctatccgacctgtgtatcgcccgaagattgtcaagaagcgaacgaaaaagttcattcgccatcaatctgaccgatatgataaacttaagaggaactggcgtaaaccaaaaggtattgacaacagagtacgtcgtcgtttcaagggccaatttttgatgcccaacattggttatggatccaacagcaagacccgtcatatgttgcctactggattccacaaggttttggtacataataccaaggaacttgaaatcctaatgatgcagaataggacatactgcgctgaaattgcacatggtgtttcttcgaagaaacgtaaagagatcacagagagagccaaacaattgtcatcagagtcacaaatggcaatgcagactccgctcacaagaaaatgaataaatgattgataacttcatataataaacgctaaaagtaaaaaaaaaaaaaaaaa

SEQ ID NO: 281 - DNA, 549 bp, Ctenocephalides felis
  misc_feature (489)..(489): n = unknown at position 489
  misc_feature (547)..(547): n = unknown at position 547
atttagatcaaattttcagtggtattacagaaaatccataaaagcatttagataacaaacaattatccaacgttacctgattgcaaatcttaaactgcattaagtgataaaacacaaagcattctgaaataaattttgttctggggatacacatgcattcacataagttcaatggcttgaagttacaataaagaaggctccaagggctgccaaaataattacgtgtctcgatctagcctgaatcttcgtccgctcgcctaatcatgcccaaggtcgtaaaagctgaaggggaggatcccgatccaaccccatacttgttcgtatctctcgaacaaaagcgtatcgatcaaaccaaaccctacgatgcgaagaaggcctgctgggtacccgacgagaaggaaggcttcgttctcggtgaaattaaggccaccaagggggatctcgtcaccgtcggcttgccggtggagagaccaaagatttcaagaaggnctcgtcgccaagtgaccccccaattgaaaaatgcgaggattgtcaaatttgctacctnac

SEQ ID NO: 282 - DNA, 549 bp, Ctenocephalides felis
  misc_feature (504)..(504): n = unknown at position 504
gaaagctcaagcgaaagaagaaaaaattgctaagcagcttgaaagagagaagctacagctagccttagctgctcgtgatagagctgagaagaaacaacaagagtatgaagacaagcttaaatctatgcaagaagaaatggaacgatcacaggctaatttaatagaggcacaagatatgatcagacgtttagaggagcaactgaaacaattgcaagcatctaaagaagaattagagcaaaggcagaatgaattgcaggcaatgatgacccgccttgaggaaacaaagaacatggaagccgcagagcgtgcaaaattagaagaagaaattcgtgcaaaacaagatgaagtgcaacgcattcaagaagaagttgaagctaaagatacagagactaggagattacagaatgaagttgatgaagccaggcgtaaaaaagatgaagtagccgctgcttgttggctgcacatcaactcctcacatcccatgtgatggaagaaatgacaccnagagtgtgagttccaaacggagtggagatatagctgcttaatctg

SEQ ID NO: 283 - DNA, 550 bp, Ctenocephalides felis
  misc_feature (496)..(496): n = unknown at position 496
aagccgcatttgttattgagaaatatatgctaaaatatattgtctcagaattaatataatgtgctgagtttgcattaatattgaaacgttttattcattctgaggcatctatataaaataaataaatatgaaagcaattttgataacattgatagtcgccgcggctgtgtattccgtaaggcctgaggttttcctggaagaaaacttcgtagacgatacgtggacaaatacatgggtttatagtgaacaccctggcaaagaattcggcaaattcgtgcacactgccggaaagttctataacgatgccgaagcagacaaaggtttgcaaacaagtcaagatgctaggttctacgctctatctcataagttcaaacctttctcaaataaagacaagacattagttgtcaattttctgttaaacatgaacaaaacattgactgtggaggtggtacttgaaggtgtcgattgaagttgaatcaaaaggacatgcatggtnaagtcctatgaaatatgtttggcctgcatttgggccaggaactaaaaggtccgt

SEQ ID NO: 284 - DNA, 328 bp, Ctenocephalides felis
catccgttcaccaattggtgtaggatccgtagctaaagtgttcggaggacgtaaacgtaatggtgtatctccttcacatttccacaaatcatcaggaggtattgcacgcaaagcattgcaagctttggaatctttgaaattggttgagaaacacccagatggtggccgcaagcttaccgttcagggaagacgtgatttagatcgtatcgctgcccaagttagggctaaacaaagggcaagaaaagataccactggtcctattgttttgtaaaacatgtttatatataaataaaaaaataagatctaaaaaaaaaaaaaaaaaaaaaaa

SEQ ID NO: 285 - DNA, 550 bp, Ctenocephalides felis
  misc_feature (535)..(535): n = unknown at position 535
cagcgatttcctttttattccggctaagtgagaaaacacaaacacaaccaaaatggacgcgatcaagaagaaaatgcaagcgatgaagctggaaaaggagaacgcaatggaccgcgctctcaactgcgaacaggaagctaaggatgccaacctgcgcgctgagaaggccgaggaagaggcccgttctctgcaaaagaagatccaatcaattgagaacgatcttgaccaaactcaagagtcattgatgcaagtcaatggaaaactcgaagagaaagacaaggctctccaaaatgccgaatctgaagtcgctgccttgaaccgacgcattcaactcttggaagaagatttggaacgttcagaagaacgtcttgccaccgcactgctaaattggctgaagcctcacaggctgctgatgaatcagaacgccccgtaaggtgcttgagaaccgttccctcgcgaggaagagcgcatggaccacttgagaccaacttaaagaagcgcgttctggctgaggaggccgccaagaaatacgatnggttgccgtaaattg

SEQ ID NO: 286 - DNA, 457 bp, Ctenocephalides felis
  misc_feature (446)..(446): n = unknown at position 446
gcaaacaacaaggtccgctgatgcaagatccacacgattgtcacgcatattacacatgtctagaaattggatcattaccgaaacattttaattgtaataaaggtgcttatttcaatacagtcaaattaaaatgcgtgaaaggaaattgcgaaaatagcacagaaattcctcttcctgagcttccagacatttgcgatgaagtaggacctttggtgcaagatccaaacgattgccgcaagtattattcatgcgtcacgattggaaaagaacctgaacattttacgtgcaataaaggggcgtattttgatcgagaaagattacggtgtgtcagaggatcttgttaacaaatattgttatataacaaagttcaatctttaattattatttagaagaatttgaaaatgtatatttaatgttttttaataaaatagtttattggcaatttnaaaaaaaaaaa

SEQ ID NO: 287 - DNA, 256 bp, Ctenocephalides felis
attgtaccaccaacaataaatttagaaaatctaactgaagatatggacttaaattatgtgcctaataaatcttgtgattggaagagttgtgataagagaatagctttgaaaaatgcttttggttttggaggtacaaatgcatcattatgtataggcgaatatagagagatataatcacataatgcttatatgctgattttaaaaagagataatataatagttttctaatactaataaataaaatatattttaatat

SEQ ID NO: 288 - DNA, 550 bp, Ctenocephalides felis
  misc_feature (530)..(530): n = unknown at position 530
cgacaacctgacgcccttgaaagacaacgaaggcattctagtgccattggtgcaatcgtgcgatgacgaccatcctgctattttccattcgatggcaccttttccattgttacgtaaagttcttgtacggttattgcattctgttgacttgatactggagaaggctaacgaaatttaccctaaccagtatcttcagaaggccaaatattattggggtaactttgaaatgttgacgtcagtaatttccccaaaacgtttgacgattttgcacgtcgattacaacggcaaaattttgggatcgatgcattcgatgacaggagacgtcaaaggcatttcgcatgccttacctcattccgatggatatctgtatttggggtcaccatttaataactatttggcacgagtacctatgcccaaatcttcgaagatcagagtgtctaaggtcacttatgagggcgagggattgatgttgctggggaaaaggtaaaggagactcctaaggaaagaagtacctaaggaaagaggtgccnaggaaaggaagccctaggtg

SEQ ID NO: 289 - DNA, 550 bp, Ctenocephalides felis
  misc_feature (512)..(512): n = unknown at position 512
  misc_feature (539)..(539): n = unknown at position 539
  misc_feature (546)..(546): n = unknown at position 546
aatcgacccagttcttatatttgttaaaccgtttgttaaaattcgcaaaaataaaaatttgcaaaaaatgcctttaaaaatcaaaaaagtgttagttagcgacgctgtcgatgcagcatgtgtggaattactaaagcaacatggcgtcgaagtgaaatgtcgaacaggaatgacgcctgcggagcttctgcaggagatccctgctcatgacggattgattgttcgctccgatacgaaagtaacacgcgaagtaatagctgcagctactaatctcaaggtggtcggcagagccggagccggcgtggataacatcgatatacctgcagcaagcgaacgaaatatcatcgtgcttaatacaccagggggtaattcaatcagcgcctgcgaactaacgtgtacgttgatggggtgtctcgcacgtcatgtagtgcccgccggtgcgtctatggtagctggacgtgggatagaaaaatctattcaggaaatgaattgatggtaaacctgccgtttangtttgggaggatggattgaagttgcangcgtatnaagt

SEQ ID NO: 290 - DNA, 550 bp, Ctenocephalides felis
  misc_feature (30)..(30): n = unknown at position 30
  misc_feature (36)..(36): n = unknown at position 36
attaattggagacgaccaaatttttaatgnaattgnaacagctcatgcatttattataatttttttcatagttatgccaattttaattgggggttttggaaattgattaatcccattaatattaggagctccagatatagcctttccacgaataaataatataagattttgacttttacctccttcattaattttattactttcaagagctatggtagaaagaggagctggaacaggatgaacagtttatcctcccctttcttcagtaatcgctcacagtggatctagagtagatttaactatttttagacttcatatagcaggtatttcttcaatcttaggagccattaattttatttctacttgtttaaatatacgacctaaaggaatatctttagaccgaataccactttttgtatgatcagtttttattactgctttcttattacttttatctttaccagtattagcaggggctattcaatattattaacagatcgaaatttaatacatcattctttgcccttctggtggaggagacccaatttat

SEQ ID NO: 291 - DNA, 362 bp, Ctenocephalides felis
  misc_feature (95)..(95): n = unknown at position 95
  misc_feature (179)..(179): n = unknown at position 179
  misc_feature (292)..(292): n = unknown at position 292
acaagctaaagatgccaacttgagagcagaaaaggtaaacgaggaggttcgtgaactgatcaagaaactcggacaagtcgaagccgatttggccntgaacaagaacaacttggagcaagccaataaggatctcgaagagaaagaaaagaccttgaccgccaccgagtctgaagtggctncactcaacaggaaggtgcaacaaattgaagaagatttggaaaaatctgaagaacgtgccggaagcgctccccaaattgttggagccacacaagctgccgatgaaaccaccgtntgtccaagtattggagaaccgctccaacaagatgaagagcgatggcccattgaccaccaattgaaggagc

SEQ ID NO: 292 - DNA, 549 bp, Ctenocephalides felis
attaattcctatgatggccggtacattaactaaactcagtggaaatattaaatacgtgaaaaaacagaataataatatttttagacaatttttgacaacaaagaattatgccacaagggtccaagcagctaagccagtggtcgaaatggatggtgacgagatgactaggatcatctgggctaaaattaaagagcaactcatttttccatatgttaaggtagaatgtttgtattatgatttgggtttgccacatagagatgccaccgatgataaagtaactgtggatgccgctcaagcaattttaaaacacaatgtcggcataaaatgtgcgacaattacccctgatgaggcaagagtagctgaatttaaattaaagaagatgtggctcagtccaaatggaaccattcgtaatatactgggcggaacagtgttccgtgaacccattctttgtaaaatatacctcgtcttgacctggatggctaaacctattataatagccgcacgcgcatggtgatcaatataaagctaagatttgagtaaatgacctgg

SEQ ID NO: 293 - DNA, 549 bp, Ctenocephalides felis
tataaattgtatatatgagcaatgaatcaatttttttaaacattttgattttcctgggccctgtagcaaacttgatatttgacaactgaaccatcaaagctatatataaatattaatcgaatttctataaatcttaaatacatattttgaattaaagatagtaaattaacaatggcagcgggggctgagcctttgtcactagctaaagatgtcaaaagagcctgcgagctccttgataaattacaaatgactggagaaataccagccacaaaaatagctgccttacaaaaagttttacaatccgatttttttactgccgttcgcgaagtttatgaacatatttatgaaacagtagatattcaaggttctgaagacataagagcatcagcaacagcaaaggctactgttgcagcttttgcagccagtgaggccatgccatccacgagttgttgaattcctaagacagatgaaggcttagggtttaatgtatgggtggaaaagaacaaaattctccatatcatatcaagaatatccagtggtgagctgtcg

SEQ ID NO: 294 - DNA, 549 bp, Ctenocephalides felis
  misc_feature (474)..(474): n = unknown at position 474
  misc_feature (485)..(485): n = unknown at position 485
  misc_feature (515)..(515): n = unknown at position 515
  misc_feature (517)..(517): n = unknown at position 517
  misc_feature (532)..(532): n = unknown at position 532
gcttatgtttgtttttattttgacgttgctaaaattttagctttaatgtttgttttcttgtgataaattagttttattttaaaggctagcgcataataataatgatgcatctgagcgctgacatatctagtgcacttcagcaacttgagagcatcaagacagcaatagatgactcccatgatccaaaacttcagctcagtactaatgaagatttggatatgataataagcctattgcaagatccagtttttcgaagcattgttactactcaagattcactaggtgaattgaattcccaaataacacaacatccatcaatattaccaggagattttgatataactacttcaggtgatctaattctgcggtgcccccttctcttgatttatatgataatgagtacactgatgaacaaagagtaccctctgacaattaagtccaggtagccctcagaggttaggtatagcatcggtnggggcagtcangggaacattacattcatgaagggatcaatntngcaatgaggcaaccntgatggatattcccaca

SEQ ID NO: 295 - DNA, 512 bp, Ctenocephalides felis
  misc_feature (30)..(30): n = unknown at position 30
atcagactgaacgagccttccagaagcagntgggtgtaaacctcaaccgcaagatcggtttaaaaaagaaatccttacgtcttcacaggaatgtaggattaggattcaaaacaccccgtgaggctattgaaggttcttacatcgacaaaaaatgcccattcacaggaaatgtatctatcagagggcgtattttgacaggtgttgtacaaaaaatgaaaatgcagcgcactattgtcattcgacgggattatctgcattatattaggaagtacaacagatttgaaaagagacatcgcaatatgtctgtgcacctttcaccatgcttcagggatgttgaaattggtgatgttgtgaccattggtgaatgcagacccctttcaaagaccgttcgtttcaatgttctcaaagtgacaaaaggaacaggttctaaaaagagcttcaagaaattttagtaatctttattacaataaacatttgttcttgtaaaaaaaaaaaaaaaaaaaaaaaaaaaa

SEQ ID NO: 296 - DNA, 549 bp, Ctenocephalides felis
  misc_feature (514)..(514): n = unknown at position 514
ggctcttggtcgaagaggctgttaacgatgataacagtgtggtggctttgtctcaagctaaaatggacgaactgcagctattcagaggcgatacagtattattaaaaggcaaacgcaggaaggagacagtttgcatcgttctctctgatgatacttgccccgatgaaaaaatccgtatgaacagagttgtacgtaacaacttgcgtgtccgcttgtctgatgttgtttctgtgcagccttgtccagacgtgaagtatggaaagcgaattcatgtgctgcccattgatgattctgttgaaggcctaacaggaaatctgttcgaggtctacctcaagccctacttcttagaagcctatcggccaattcacaaggacgacacatttattgtccgtggcggtatgagagcaatagaattcaaagtagtcgaaacagatctgcttcttattgatcgtggtcctgcacagtcattcattgcgaaggggatccaatcaagcgtgaggaagagaagagctcnatgctgcggtatgatgatattgtggtgagaaacat

SEQ ID NO: 297 - DNA, 296 bp, Ctenocephalides felis
  misc_feature (102)..(102): n = unknown at position 102
  misc_feature (121)..(121): n = unknown at position 121
cctaataaattaggaggagttattgccttactattatcaattttaattattattattttacctattaataataaaatatttttaagaaattcattttatttnttaaataaaattttatttngatttttcatttatattttaattttactaacatgaattggagctcgccagttgaagaccttatattattcaggacaaattcttacaattctatacttttcttattatttaattaatccatatatttattataaatgagataatttattattataaaaaaaaaaaaaaaaaaaaaa

SEQ ID NO: 298 - DNA, 549 bp, Ctenocephalides felis
  misc_feature (505)..(505): n = unknown at position 505
  misc_feature (535)..(535): n = unknown at position 535
ggaacatttattcgtgaagctagcactagtcatgcattgtttggtaaacatattctcactgtagacatgttcaacaaagaacaattaaatgatattttcaatttggctgaaaatatcaaagctcgcgttgtcaaagatcgaccagtagatgaaattttgcgcggtaaggtaatggcttctatcttttatgaagtgagtactcgtaccagctgcagctttgctgctgcaatgcagaggctcggaggccgagtgatccatatagatgaaactagctcatctgctaagaaaggcgaaactctagaagattctgtttctgtcatggctggttactcggatgtaattgtacttcgccatccagaaccaggagcagtagctaaagtggctgcgcactgtagaaagccattaataaatgctggcgatggagttggcgaacatccaactcagcgtgcttgatatatttactattcgtgaagaaatggtccgttatggttgactatactatggncggacttgaaaatgcgtctgacctcattgntcgttggtgcgtat

SEQ ID NO: 299 - DNA, 549 bp, Ctenocephalides felis
  misc_feature (540)..(540): n = unknown at position 540
cttcaaacctttaatgttttgaaacacaaactgttcataatcaattgtagttttgtgataaaactcaatatgatcgtataaacctgtgtacctagaaaaaacagaggagcagggagggagtggacattttattctggatttccttgatggtgtacctataaaattttccttagtactgattggggaactgggaatgggaggcgtgtgaatttgaactttagtagaggaagtacaaggatgtggcgataaacttacgtgggaatgtttgtgaagacgatctgatatggaaggagcagaggtaaaagatgagcaagcagaaagtggatatcttagtttctcttttgttgatggtgtacctgtaaaattttccttagtactgattggggaactgggaatgggaggcgtgtgaatttgaactttagtagaggaagtcaaggatgtggcgataaacttacgtgggaatgttgtgaagacgatctgtatggaaggagcagagtaaaagatagcagcagaagtggatatctagttctctttgtgtgngtcctgtaa

SEQ ID NO: 300 - DNA, 549 bp, Ctenocephalides felis
  misc_feature (537)..(537): n = unknown at position 537
cttaagtgttcagaatgccacaatcaatgcatgtaaatggctatgccaacggccacagcggttccttcgatatggaggatggatctgttttcttgtttacttcggaatctgttggcgaaggacatccagataaaatgtgtgatcagatcagtgatgctgtattagatgctcacttgaagcaagatccaaatgctaaagttgcttgtgaaactgttactaaaactggaatggttctcctctgtggagaaataacttccaatgctgtagttgattatcaaaaagtggttcgtgacacggtgaaacacattggttatgatgattcatctaaagggtttgactggcgtacccttaatcttctggttgcattggaacagcagagtccagacattgcgggtggtgtacacatgaataggcaagaacatgacataggtgctggggatcaggtttcgactataggacctgcaatgtctacttgcattgatctcagcacctatatagcagctggagtcatgacatcgaaggatgaaaaatgggcangaaacagggtta

SEQ ID NO: 301 - DNA, 475 bp, Ctenocephalides felis
  misc_feature (87)..(87): n = unknown at position 87
  misc_feature (95)..(95): n = unknown at position 95
  misc_feature (132)..(132): n = unknown at position 132
  misc_feature (181)..(181): n = unknown at position 181
gttttggcaatgtcgcaccgtaagttttccgggccgagacatggctccatggggttctaccccaagaagaggtcccagcgtcaccgnggtaaagnaaaggctttccctaaagatgaccctagcaaaccagtncatttaactgcctttattggttacaaagctggtatgacccacgtgcttngtgaggcagacagacctggatcaaagatcaacaagaaagaaattgttgaagccgtaactattttggaaacaccacccatggtcgtggttggagctgtcggttatattgaaactccacatggtctacgggcattggttactgtttgggctgaacatttgtcagaggaatgccgccgtagattttacaaaaactggtataagagcaagaagaaggctttctctaagtcctcaagaaatggcaagatgagcttggtcgcaaatcaattgaaagggattgaagaaaatggcaaatctg

SEQ ID NO: 302 - DNA, 549 bp, Ctenocephalides felis
gtgtattcatattaaaaactgctgaatccacgtgtgtataatgtcagacgcagtggtggcaggaagtggcggacaacctaattctggacaaatcaagaaagaattatcggaaggcattatataccagaccgcagaaagtccaggatcaacatgctgcacagcgctgtattccgatgtagaagtgataaagatggaaatttcggatcattttgaagttgttgacccgaaatctctacagatagcaaatagtccgggtagtccagatagacaattctgcagctcaaccacggcgtcaattggggaaattacgacaaacgatgatattaaagaagacagtccaaggcgtctttgccttgtttgtggtgatatagcctctggattccattacggcgttgcctcatgtgaggcatgcaaagcattttttaagagaacaatacagggtaacatagagtataattgtccggcagttggagattgtgaaatcaataaacgaaggcaaaagcatgtcaagcctgtcgattcaaaaatgttagcattggatgtaaaaga

SEQ ID NO: 303 - DNA, 549 bp, Ctenocephalides felis
  misc_feature (541)..(541): n = unknown at position 541
gccgtcaaaaatggctggagtattatttcgtgttaatttggctaaaacacaattgggcataatcagcccagtttttacaattagacataacagcggtggaccaccaccaccaggcactccacctccacaaacacgtactaaatttggtcctcttaaagatgaagacagaatttttacaaatctttatggacgtcacgattggagattgaaaggatctttgaaaagaggagattggtataaaactaaagaaatcattcttaagggagctgattggatcataaatgaaattaaaacttctggactcagaggtcgtggaggtgctggttttccttcaggtttgaaatggtctttcatgaacaaaccaggagatggaaggccaaaataccttgtggttaatgctgatgaaggagagccaggaacatgtaaagatcgtgaaataatgcgacatgaccctcataaattggtggaggctgttaattgcaggaagagcatggcgctcgactgctcattacatagaggagaatttatatgaacatcaatntcagttgc

SEQ ID NO: 304 - DNA, 406 bp, Ctenocephalides felis
gttaatttaaaataacaaaatgaaaggaacattattaatattatcatgtcttgtgatcatgataagtgccgaatatgctgacgtagatgtgtgccaagatttggacgatggaacttttcttgctgattcaaacaattgccaaaatttcttcatttgtgatggaggccgagcttggaaaatgtattgtccaggatcacttttatggaatgatcacgaaggaacatgtgattacgcacaaaatgtagaatgttaccaaccagaataaaacattttaatatctgacagcgattttctgaaactatatttcatactactgttataataaatttatcttcattgctctcctcctataaatttattccgttttaataaaatcaatataaagacaaaaaaaaaaaaaaaaaaa

SEQ ID NO: 305 - DNA, 549 bp, Ctenocephalides felis
  misc_feature (524)..(524): n = unknown at position 524
  misc_feature (539)..(539): n = unknown at position 539
ctgataccatcgaagccagtgctgattcatgacttgggtcgtgtttatatacaaactggtcctgatgttaagaggtgcattcttagattattagagggaccagttagacaactcggcatggaaaatactgaattgatgaaattagttgaggcctgtgcaaagggatctgaaaccttggttacaagggtgatacatattttgaccgaaagaagtttgcctagcatggaactagtttctagagttcgagatctttatcacactaaagtatctgatgtccgattcttaataccagtattaaatggtcttaataaagacgaggttatagattctttgcccaaattcattaaactaaatccagtagttttaaaggaagtttttaataagctgctgaataatcaagcaggtcctacatcatatcctagtccagttacacctatagagttgttgtagcgtacatacaatagacacaactagtgcagatttaaaattcgagtgaaagcaacaagttgtgttagcagagaagnaattacacccagaangatgcagagt

SEQ ID NO: 306 - DNA, 534 bp, Ctenocephalides felis
  misc_feature (4)..(4): n = unknown at position 4
tgangatcggcttgtgcgcgtacagtggatacaaaatttatcccggccatggcaaaaccatggtcaaaattgatggaaagacattcactttcctcaattcaaaatgtgaggctgctcatttaatgaagaggaacccacgtaaagtaacatggactgtcttgtacagacgcaagcacaagaaaggtcaagaagaagagttgactaagaaacgtactcgtcgtacacagaaattccaacgtgctatcgtaggagcttctcttaatgacatccttgccaagaggaacatgaaacccgaagtacgaaaggcacaaagagaccaagctatcagggctgcaaaagagcagaagaaatccacgaaagcagcaaagaaggctgcagctccacctaaagtgaaagccccaccaaaagctaaggccgctaaagtgagccagaaagcacccccagggttggcggtaaacgataagtggtgttggagattattctaatgtattatatgaaaaataatttgtaaaatgctaaaaaaaaaaaaaaaaa

SEQ ID NO: 307 - DNA, 549 bp, Ctenocephalides felis
tgaaaaactacgatccccagaaggacaagcgtttcagcggcaccgtaaaattgaagcacattccacgaccaaaaatgcaagtatgtattttgggagatcaacagcattgtgatgaagctaaggccaacaatgtcccatggatggatgccgaagctctgaaaaaacttaacaagaacaaaaagcttgtgaagaaactagctaaaaaatatgatgctttcttagcttctgaatctttaatcaagcagatcccccgtttgttgggtccaggtttgaacaaggcaggtaaattccctggtctcttgtctcatcaggaatccatggtgcagaagattgatgaagttaaaggaactatcaaattccagatgaagaaggtgttgtgtttatctgtagctgtggtcatgttgatatgtctcctgacgagttggccaaaacgttcacttgtcaattaacttcttggtgtcacttttgaagaagcattgcagaatgttaggtctctcatgtcaaatccactatgggcccccaaagatatataatacataatgatatgtt

SEQ ID NO: 308 - DNA, 549 bp, Ctenocephalides felis
  misc_feature (472)..(472): n = unknown at position 472
  misc_feature (524)..(524): n = unknown at position 524
gcaagttagggatcttgatattaacactacagaaagacttaaaggtgttatggatttagtatttgaaaaggctgttgatgaacctagtttttctgtagcttatgcatatatgtgtaaagagttagctcttatccaagttcctgctgaccaacaaaacggtcaatcttcaactgttgaatacgtcaatttccgtaaattgctcttatcccgttgtcaaaatgaatttgagaaaaatacagtagatgaaaccgcaagagaagttaaactgaaagaaattgaagcgtgtacagaccctgagaagaagaaggaactacagtttaatttagaagaagaagagcgaaagattcgtgttaaatctgttggaaatgttagatttattggagagttattcaaacaaggtatgttgccacaaaaattatgatgcagtgccttaggatgctctgcagtcaattgaagaagaaagcctcgagtnctggcaaattgtgcgacattgccggatttagaaattacaaaatcaagatttnaacctctttcttaaaatgcaagaat

SEQ ID NO: 309 - DNA, 549 bp, Ctenocephalides felis
  misc_feature (503)..(503): n = unknown at position 503
atttgtatttatgatttagatttatagtgcattaagatttgtgcttcaaaaatgttatcacgtgcctcatatacttcatctgtattcttaaattcgctgcagcaatttcgtttacaaagcacattagtaattgctgaacattcaaatgcaaaattaaacccattgactcaaaatgctttaacagctgcatcaaaaattggaggtgaagtaacagttttaattgctggcaaaaattgcaaaccgcttgctaatgaagttgccaaagcagcgggtttgaaacaagtcttattagcggaaaatgctgcatttgaaaactgttctgctgaagccttgacaaaacttgttgttgcagttcaagagcaatataaatttacgcatattattggtggtgcaagttcccttggcaaggctgtattgcaagaatagcggcaagttagatgtttccctatttctgaaataattgatgttaaagatctgaacattcgtcgacaatttatgccggnacgctttcagacactgaggtgaaagatccctaaagctatcttcgtg

SEQ ID NO: 310 - DNA, 549 bp, Ctenocephalides felis
gcccagtgcacgaggagcatgaggaaccagatccaagaagaactgagcgcttcgatgcaatacttggccatgggggcgcatttctcaagagacactgtcaacaggccaggatttgctgagatgttcttcaaatcggcaagcgaagagagggaacatgccatgaaactcatgtcttacttgatgatgagaggagaactgaccgagaggctgcaggacttgatcagaacaccaactgttccaatcacgacttgggctgatggtttgagtgctttgaaagatgctctgaaattggaggcttccgttaccaagaagattaaacatgtgatcaaagcttgcgagaacgataatggagctaatgattatcatttggttgactacctgaccggtgaattcttagaagagcaatactctggtcaacgtgacctgccggaaagatctccaccctgggcaagatgatgaaccaacaaggtgttctcgggagttcttgttgacaagaaactctgggttaaatgaaacatacatcccatcaaatatcacagtaataaaata

SEQ ID NO: 311 - DNA, 548 bp, Ctenocephalides felis
aaaaacaaaattatttgatacattttaatctagaatcatctgtgtggctaaatattatttgtgtttcaatttcgactatttgacgaaaatagataatagaaatggcacctaaagcatttggtgatgtgaaaatgcaaggacaagcatataaagataaaagtaaaccggctgatattcgtagcagcaatatatgtgctgcgaaagctgtttctgatgcagtacgtacaagtttgggacccaggggtatggataagatgatccaagcctcaaacggtgaagtgacaattaccaatgatggtgccacaattttgaaagaaatgaatgttactcatccagcagctaagatgttggttgaattgtctcgggcgcaagatattgaagctggcgatggcacaacatcagttgtagtagttgcaggtgctttgctggaggctgctgaaaagttacttcacagaggacttcatccaactgcatttctgatgcatttcaaagatgtgctccaaagctgtggaaattcttacacctgtcacaccaattgacttactgtc

SEQ ID NO: 312 - DNA, 549 bp, Ctenocephalides felis
tgtgtattattcgcacacgtgaaataaatcatatcggtaaacttgtaatatctattttattaactaataagcgtagtttgtgtaataacaagtaatttctattagtagtcataagtaattgaagagaaaactattttccatataagaattgaaagcataaaatgattctctccgtgctgaaaaaatctcgcatcgtgcacttgtgttttgccatttcattcttcacatcaggcctgatcataaacattgcacaattcatattatacacatgtctcaagcctttcaacaagaggctttacagaaaacttggttattatttgtgctacacattttacagtcagatagtgtttttagctgactggtggtccaaatctaatctgaccttacacatatcaaagaaagattatgaacaatgtgggaaggaacatggtcttttaattatgaatcatacgtacgaaacagattggtattaggatggatgtttacggaaaaaattggtgtcttggaattgtaggatatgcaaaaagactattcaatacatccgcatta

SEQ ID NO: 313 - DNA, 549 bp, Ctenocephalides felis
  misc_feature (529)..(529): n = unknown at position 529
aaaaaatattattctaacattatggcgcagatacctgcacgaccgaaaattttgttaactcatccggatataccgaaggaagctattgacatcatgtctcccaattgcgaaataattatgtgcaccggacgtccgtctccatcacgacaaggaattttggaaaaaattgtgggagttcatggtttaatgtggtgtactaaagaacgtttggacaaagagatattagatgctgcaggacccaacattatggccatatctactatgtcggctgggctggacaatgtagatttacctgaaatccgcaaaagaaatattccaattggttatactgcaggagttctgaataatgctgttgctgatttaactgttgggcttatgatagctactgctagaagatttggagaagctaggaaacacatagagaatggaacatggggaagcggacctgcgtggtttttaggcagaaatgtatctgaaactcagctggtattgtcggctaggagaaattggcaaactgtgcaagaagatngaaagcttcaatatgactat

SEQ ID NO: 314 - DNA, 549 bp, Ctenocephalides felis
  misc_feature (532)..(532): n = unknown at position 532
gtggtgcaggatttgtagatggtatgaatcttggagataacaccaaggcagcagttattcgtcttggtttaatggaaatgattcgttttgttgatgttttctatccaggaagtaaactttctactttctttgaatcttgcggtgtggctgatttagttactacatgttatggtggtagaaatcgtagagtttctgaagcatttgtgaaaacaggtaaatcattgaaacaattagaagacgaaatgttaaatggtcaaaaattgcaaggaccaataacagcagaagaagttaattttatgctgagaaatcgtggcatgcaagacaaatttcctttgttcactgctgttcataaaatttgcacaggagatatggatgttaaagaatttcttaattgtataaggagccacccggaacacatgtaagtgcctgctttataaaatataaatcagatttaaaatgcttctcagatggtaatattagtaatgtctttacatgaacataagtgagagttgctagttgtttgatattttgntcttcatatagtatttg

SEQ ID NO: 315 - DNA, 550 bp, Ctenocephalides felis
  misc_feature (365)..(365): n = unknown at position 365
  misc_feature (409)..(409): n = unknown at position 409
  misc_feature (427)..(427): n = unknown at position 427
  misc_feature (441)..(441): n = unknown at position 441
  misc_feature (447)..(447): n = unknown at position 447
  misc_feature (457)..(457): n = unknown at position 457
  misc_feature (543)..(543): n = unknown at position 543
cttgtgccggtccgagagcaccctaaattcaactttgttggaaaactgttgggacctaagggtaattccatgaaaagattacaagaagatactatgtgtaagatggccgtcttaggtagaggctcaatgaaagacagacaaaaggaagaagaacttcgtaattccttagatcccaaatatgctcatttggctgatgatctacatgttgaaatatcggctttgggtcctccacagaagctcacgctcgagttgcttatgctttggctgaagtccgtaatatttggtccctgataataatgatacaattcgccaagaacaatgcgtgaaatgatgactgacccaatgcccgccagaagaaatgagangagcacccacattagacgaggtggttggctgtggtgcttctcgngaggaggatactaatcgngcagcttcgacatntggggnatgcttctgngttctaatgtgatccggcctcacccctcctcactcgtgtatcctgtaactaaatcttcattaataacaaagtgctgagaacttgtntaaaccc

SEQ ID NO: 316 - DNA, 550 bp, Ctenocephalides felis
  misc_feature (33)..(33): n = unknown at position 33
  misc_feature (406)..(406): n = unknown at position 406
tcttattcatattaattataagaacatttattngtatttcttcaaattcttgattaggagcatgaattggattagaaataaatttattatcatttatccctatactaaatgataataaaaatttactatctaatgaatcttcattaaaatattttctagttcaagtttttgcttcaattttattattattttttatttctttgaattttttatttaaaaacttttttagaataatatattttaatgaaatttatttaattttattaaattcatccctatttttaaaaataggggctgccccatttcacttttgatttcctagaataatagaaggaataaattgaataaataattttattttaataacatgacaaaaaattaaccctataatttgttaagttattgnattaatataaattattttatttaattcattattaagaattataattggagcttaggtggattaaataatcctcttacaaaaattatacttattctcaatacactatggctgaataatattgtttaataaataatgaataatttt

SEQ ID NO: 317 - DNA, 474 bp, Ctenocephalides felis
  misc_feature (4)..(4): n = unknown at position 4
  misc_feature (456)..(456): n = unknown at position 456
  misc_feature (467)..(467): n = unknown at position 467
gtcncattggtgccttccaaacccatgtgtgtcgaatccttccaggagttccctccattgggtcgtttcgctgtgcgtgacatgagacagaccgttgccgtcggtgtcatcaagtctgtgaacttcaaggatgcctccggtggtaaggtcaccaaggctgccgaaaaagccaccaagggaaagaagtagctagatctaccgatctgcttactgcagatgttcaacactgtaatgaaacactacttccatcgcaaagcgtttcgaagaaaaaaggcctcattcattcctttactatatgttttttgactcagctttatattttatatgactattttatagaataataattattttatgttctgctctatattaaaatgaatttatattaatgtatggatattatgtgctaagaaagaacttgaagagatttgcagctgatgtgtattatagtatggnataaatggaanccaaagt

SEQ ID NO: 318 - DNA, 356 bp, Ctenocephalides felis
agtttgctacacacagcacgtgtaaattttcataaaataaattaaaaatggataaacctgtagttcttgctcgcgttatgaaagtcttgggccgtacaggatcccaaggacaatgtacacaagttaaagttgaatttattggtgaacaaaaccgacaaatcatccgaaatgtcaaaggaccagtacgagagggtgatattttaacacttttggaatctgaacgtgaagctagaagactaagatagattaattctaaaatgtgagaggtgatatcctgaactataatatctgggttcaattatttgtatggaattataaatatacgacttatcactcccaaaaaaaaaaaaaaaaaa

SEQ ID NO: 319 - DNA, 550 bp, Ctenocephalides felis
  misc_feature (537)..(537): n = unknown at position 537
aaataatctctgaaaatgttgaagggcgttgtaggtcttgttactggaggtgcttctggtttgggaaaggccactgtagagcgaattgtgcaacaaggtggccgagttgttttatgtgatttacctaaatcaagtggatctcaagtagcaaaagatattggagataattgtttatatgcaccagttgatgtcacatctgaaaaagatgttgaggaagcaatagcattaactaaagaaaaatttggtcgtcttgatgttgctgtaaactgtgctggtatcggtgtagcatttaaaacatataatttcaataagcagttgcctcataaattagaggatttcacaaaagttttaatggttaatactgttggaaccttcaatgtaattcgattgctgtggattgatgggagtaaatgaacctaataaggatggtcaaccaggagtgattgtaacacacaagtgtgctgcttatgatggcagatgggacaagctcttattctgcgtccaagggctttgtggaatgcactgcttttgctaganattaccaggcaag

SEQ ID NO: 320 - DNA, 550 bp, Ctenocephalides felis
gattcagctttgcatagaattgtagatgcaactgatgcaattgttagcactgcatattcccataaaagaacatttattatggaagtaatgggacgaaactgcggatatttagctgttgttgcaggcttgtgtgttgaagctgattttatatttgcgcccgaagatcctccagatgccaactggccaagtgttttatgcgcactattaagtcaggaacgattagctggaagaaggcaaaatattatcatggtatcagaaggggcaattgatagaaatggagaacctataacagcagaaaaaattaaagaagtcattattgcaggtttaaatcaggatacaagaattacagtgcttgccatgtacagagaggtggaagtccttctgcttttgatcgattactgggatgtcgcatgggggcagaagcagtattagcccttatggaagctcatgatgagtctgaccttgtgttgtgaccttgcccgaaccaacagtcgtcttcaatgatggaatgtgttctcaccaaactgtacttacgcttggaaaataaaat

SEQ ID NO: 321 - DNA, 550 bp, Ctenocephalides felis
gtcaaacatcacaaaaatatatagctttatgtgtcacaaatgattacacttttatcgttatgatataatacaaaataaatacaatttcttacatgctattattataattcaatattaaaacatttgtactataatataacaatgaatttcttatatttattaatatgctctctttgtgcggtagtaaatgccggtggggatacattagttttattagacaatcttgcaattaaagaaactcattccatattttttaaaagcttacaagatagaggttatgttctaacattcaaattggctgatgaagccaatttagttttatctaagtatggagaatatttatacaagcatttaattctattttcacctgctgtggaagagtttggaggatcattaagtgtcgaggcaattcagaattcatagatgaaggtggcaatgttttggtagcaggaagtgaatcctggtgatgcaattcgtgaatagctctgaatgcggtttgaggagatgaggaaggacactgtatggacatcttaatatgatggtctgataa

SEQ ID NO: 322 - DNA, 546 bp, Ctenocephalides felis
  misc_feature (28)..(28): n = unknown at position 28
  misc_feature (488)..(488): n = unknown at position 488
tttttttttttttttttatttgcattgngatagccggccgattgcattcagttctaaaatgccgatcaaaagtatcaaagctcgtcaaattttcgactctaggggcaatcctaccgtcgaagtcgatttagtgaccgaattaggattatttagagcagcggttccttcaggtgcttccacaggagcttatgaggctcttgaattacgtgataatgataagactcaatatatgggtaaaggagtatccaaagcattgcacaatattaatcaattgattgcccccgagttaattaaacaatcttttgaggttactcaacaggaagagatcgacaaatttatgttgaaactggatggtactgagaacaaatctaaatttggagccaatgctatattaggagtttcattagctgtgtgcaaagctggtgctgctaaaaagggtgttcctctgatcaacatattgcagatttggctggaaataaaaaaaatgngcttcctgtccactttcaatgtatcaatggcggagcatgctggaataactgtttcaga

SEQ ID NO: 323 - DNA, 550 bp, Ctenocephalides felis
  misc_feature (545)..(545): n = unknown at position 545
cagaagctcaagccagagccgaagaagtcgaggaaatcaggaggaaatacagtgccagaatccaagaacaagaggagcacatcgagaccttgttggtcaagatcagcaatctggagaaacagaagagcagactgcaaagcgaagttgaggtcctcatcatcgatctggagaaagcaaacagcgctgcccgcgatttgcagaaacgttgcgagcaattggaacgtgtcaacatcgagatcaaatcacgtcttgaggagaccattcagttgtatgaaggagcccagagagatttgagaaccaagcaacaggagttgcagagggtcaaccacgaattggacaagaccagggaacagaaagatcagttggccagggaaaacaagaaattgggagacgaattgggagatgctcgcaaccagttggccgaatacaacagacgtttgcacgaattggaactcgaattgagaagactcgagaatgagccgaagagttgctgctgcatcaagaggccgaactgtcgcaaggccaagacacgttccacgttggcnacgat

SEQ ID NO: 324 - DNA, 550 bp, Ctenocephalides felis
  misc_feature (5)..(5): n = unknown at position 5
  misc_feature (522)..(522): n = unknown at position 522
  misc_feature (527)..(527): n = unknown at position 527
  misc_feature (535)..(535): n = unknown at position 535
gcaantcgcaaacgagtttcagagcacagcggctgcgcatctgttaagctcaacggctatagtttttcagtattataatttgtattaagtcgaagtaaataacaaacatgagggaaattgtgcacattcaaaccggacagtgcggaaaccaaattggagctaagttctgggagatcatttctgatgaacatggaattgacccaactggagcttatcttggagatcatgaacttcaattagaacgtatcaatgtttattacaatgaggcttctggtggaaaatatgttccacgtgccattcttgtggatttggaacctggaaccatggactccgtgcgttctggaccatacggtcaaatttttaggccagacaattttgttttcggacaaagtggtgctggtaacaactgggctaagggacattatactgaaggtgctgaactagtcgactctgtttggatgttgtgcgtaaagaagctgaatcttgtgattgctgcaaggttccactacccattcttgggangtggnctgcttgnatgggacactattga

SEQ ID NO: 325 - DNA, 550 bp, Ctenocephalides felis
cagcaactcatttaatatttgtggatcctgatgcgaaaaatgaaacatggatattacacacacatattgcagcagtagaacgattaccgttgagtactacaggatgcccacttcaaattcgatgcaaaacattccaatcagtaatatttcttataagaaaagaaaacgatagccatgacgtttataatactttgttgcaattagcccaacctgtttctatcgatgatctgtattgcttccagtacaccataaataaaaatgatatgcataagagcgaaggttggaattattttaatttagaggatgaatttaaaagaatgaatgttccaaatgatgaatggatttacacagatttaaatgaaaattatgagctatgtgatacttatcctaattgttgtatgtgcctgctaacagcacaataaatatgttacaaggaagtgcaaaatttcgatccaaaggaagataccggtctcacatattacacaagaacaagcttcaatatgcagatcagcaacctttctggttcagtgcacgatgtctgagatgacaa

SEQ ID NO: 326 - DNA, 550 bp, Ctenocephalides felis
aaaattttaattttaattattatgtgttcctttatcattgatgcgagaagtaaaagtttcgaaataaagttaagacggtggaaaagtcctcgacttcaattgattgaaatggatcgaaatatgcgtatagcggtttggaaagatattcaagaaaacgaaagctattattcggatccatctaaacctaaacctcctccaggtcctaaggacaatgatactatagcaatttataaatttttagatactgaattttatgctgaggttggaataggccatcctgtaaagtatttcaaacttgtggttgacactgcatgggcagaaacatgggtggcctcgaaacaatgtgggttaaagtgtgttggatgttggaatcttaataaatatgactctttggcatcatcaacatttcaagaaaacggtaaagaattttcttttggctcagcaaagaaccataacagggtcttctcaatagaaagttttatattgccacataaatgttaaaatcagactttggggaagtacatgtttgccttgcactctgtttcaaaca

SEQ ID NO: 327 - DNA, 542 bp, Ctenocephalides felis
  misc_feature (539)..(539): n = unknown at position 539
agctcacagaattcagggctagctttaaccacttcgacaagaaccgcacaggacgtttggcgcctgatgagttcaagtcatgcctggtttccctcggctactcgataggcaaggatcgtcaaggcgatttggacttccaaaggattttggcagtagtcgatcccaatggaactggatacgtccacttcgatgcattcttagatttcatgacccgcgaaagtacagacaccgacactgccgagcaagtcatcgacagcttcagaatcttggcctccgacaagccatacattctgcccgatgagttacgcagagaattgccaccagaccaggccgaatactgcattcaacgtatgccaccttacaagggacccaatggtgtacccggtgctctcgattacatgtccttcagcacagccttgtacggtgaaagcgatttgtaaggtagaataaattttcataaacatttaagcaaacatttgacaagtacacataaaggtaaataatgaagttatgagagttacgatcaaaattagcattgngct

SEQ ID NO: 328 - DNA, 542 bp, Ctenocephalides felis
  misc_feature (2)..(2): n = unknown at position 2
gntatggaaaaagccgaaaagctgggccatcgcgttcaaaaatgtgtggttgtcgctcatctgaaacgtgtcactcctggaaccagcgaggagatcaatggagtcgagactcctatgacagatggccgcgaccattggtggcatgaggaaatggacgaagttgaaccagcatgttacccagaatggatggctgctgaggatccattgttcatgctttatacaagcggctccactggtaaaccgaaaggggttctacatactacaggtggttatctattgtatgctgccaccacatttaaaatggtttttgactacaagcccgatgacatctactggtgcactgctgatgtaggatggattactggacattcgtatgttgtctatggaccattagctaatggcgccacctccgttatgtttgaagggacgccattttatccggataacgatagatattgggcggtattgaaaaatacaaagtgacccagttttacacagcaccaaccgcataagacttgatgaagttcgggaagaccagtcaa

SEQ ID NO: 329 - DNA, 542 bp, Ctenocephalides felis
  misc_feature (31)..(31): n = unknown at position 31
ttgagaaacttctcaaaattgataaaaaagntgctgtagtaatggccatggatatgttgttagcaggagttgatactacatcaaatagtacagcatttttgctgtatttcctggctacgaatcaaaaatgccaagataaactacgtgaagaaatcagaacaattctgccaaataaggattcacatgtaaataacgaatcatttcaccatttgccgtatttgagagcttgtatgaaagagtcgagtagaatattgccaataattggaggcactgttaggaaagtaccagtcgatattgttttatcaggatatcaaattccgaaggggaccgaggtggttctaagtcatcttactacatcaatgaaaagcagtcaattccctgaacctgaaaaattcatgccagaacgatggctgagcagccaggaatcagaaggatgtcctttagcaaaaaatgctcatccattttcgcacatgccttcggtttgggcctcgcactgcgtgggaaaagattgcagatttggaaatggaactttatatgaagta

SEQ ID NO: 330 - DNA, 539 bp, Ctenocephalides felis
  misc_feature (14)..(14): n = unknown at position 14
  misc_feature (29)..(29): n = unknown at position 29
taaaaattttaatngcttattcttcaggngttcatataagaatagtattaggaggaatttttactataaatatattaggtattgtaggtaggtttattttaataatttctcatggattatgttcttctgggatattttgtctttctaatattatttatgaacgatcaggaagacgaagaattttaattaataagggtttaataagatttataccttcaataacattattttgatttttattatgtagatctaatatagcagctcctccttcattaaatttattaggtgaaattatattgattaattctataataagttgatcaataatattaatagtattaattataataatttcatttataagagcaaggtatagactatatttatttgcttatagtcaacatggaataagaagaataagactatattcttgtcttctggaagggttcgagaatatttattattatttttacattgattccattaaattattaattttaaaaagagattattataattatttataaaaaaaaaaaaaa

SEQ ID NO: 331 - DNA, 542 bp, Ctenocephalides felis
  misc_feature (2)..(2): n = unknown at position 2
  misc_feature (32)..(32): n = unknown at position 32
gnctaatcgaagtgatcgtaaaatattaaatngacagctatttgttaaaacaattgtgcattatagaaaaacatttaagtgaaaattaattacgtttcagcagaaatacatcttctttgtaaatttggggttaataatctttcaaaatgcagatctttgtgaaaactctcacagggaaaaccattactttggaggtagaaccttcagataccattgaaaacgttaaagctaagattcaagataaagaaggaatcccaccagatcagcaacgtttgatttttgctggtaagcaattggaagacggcagaactttgtctgactacaatatccaaaaggaatcaacattgcatttagtattacgtcttcgtggaggtatgcaaatctttgtaaaaacattgactggaaaaactattacattagaggttgagccctctgatccattgagaatgtaaaagctaaaatccaagataaagaaggaattccccagatcagcagcgtttgtctttgctggcaaacaattagaagatggaagacttgtctga

SEQ ID NO: 332 - DNA, 542 bp, Ctenocephalides felis
  misc_feature (3)..(3): n = unknown at position 3
  misc_feature (32)..(32): n = unknown at position 32
  misc_feature (38)..(38): n = unknown at position 38
gtnacattgatcggatctgttagcaaaggctnccaaantgccgaaatcgatgaatgttcgtgtgaccacgatggacgcggaactggagttcgcgatccagcagaccaccactggaaaacagcttttcgatcaggtggtcaagacgatcggtctgcgcgaagtctggttttttggactccaatatactgacagcaagggtgatttgacgtggattaagctttacaaaaaggtcatgaatcaagatgtcaaaaaggaaaatccacttcaattcaaattcagagcgaaattttatcctgaagatgtagctgaagaacttatacaggacattacatctcgtcttttttatcttcaggttaagaacgctatactgtctgatgaaatatattgccctcctgagacatcggttcttctagcatcttatgctgtcaagcccgacatggagattttcaaaaagaccaacactcttctggattttggcgaacgatagactgtaccacaaagggtaatggatcaacacaaaatgtctaaagaagaatgggaac

SEQ ID NO: 333 - DNA, 542 bp, Ctenocephalides felis
cagacactgacaaaggcaaaaatgggtcgtcgaccggccagatgttatcgctattgcaaaaacaagccctaccccaaatctcggttctgtcgtggtgtgccagacgctaaaattcgtatcttcgatttgggtaagaagaaggcaggcgtagaagattttccactatgtgtgcatcttgtatctgatgaatatgaacaattgagttctgaggcactggaagcaggacgtatttgctgtaacaaatacctcgttaagaattgtggtaaagatcaattccacatcagaatgaggctgcatcctttccatgttatccgcatcaataaaatgttatcgtgtgctggagctgataggctccaaactggaatgcgtggtgcttttggaaaaccacaaggtactgttgccagagttcacatcggtcaaccaatcatgtctgtcgttccagtgacagatacaaggccgctgttgtagaggctctgcgtcgtgctaagttcaagttccctgcagacaaaagatctatgttccaagaaatggggattcactaa

SEQ ID NO: 334 - DNA, 542 bp, Ctenocephalides felis
cacaagttctattcaaccagatagaatcttacttatggatacgtttttccaaattttgatcttccatggagagactatagctcaatggagagctttgcgatatcaagatatgcctgagtatgaaaatttcaaacaacttttgcaagctccagtagatgatgctcaggaaattttattgacacgttttccaatgcctcgttatattgataccgagcaaggtggatcacaggctcgatttttattatccaaagtcaatccctcgcagacacataacaatatgtatgcttatggaggagacggaggagcaccagtattgactgatgatgtgtctcttcaagtatttatggagcatctaaagaaattagcagtatcttcaaattcataaaattatataaagacagaaatagatatacaaatcttattttatctgtaatattgtgtgtcagtctttatatttgcaatatagataagtaataaattcaattgattatgaacctaaatacattgatatattaaaagaacatttacactaaaaaaaaaaa

SEQ ID NO: 335 - DNA, 542 bp, Ctenocephalides felis
  misc_feature (538)..(538): n = unknown at position 538
caggagaaagcttcagttcgtgcacactaaatgtgttagtaccaggcgagaagaaaaagacaccagctttcagcactttcccagagtccgccagcgtgcaagagggcgagagtgcatcgttcttagttcgcacagaagacgaagttcttggacttcaatggataaaagatggtaaacctattgacgagaagagctctcgctatcgattcacaatggagggcaaaacgaccttccgattagagatagtatcctgcgccagcatagacgtgggccaataccaagccaaagccatcggtaagacaggagaaacattcgctgcgttctcagtgaatgtcgcagccgagcattgagccgaacaactaaattaataaccgatcctgcacacggcttaggccaaaaaacgagacgactcgcgttgaatcgcgagatatcgtgtaaacttaagtttattaaattattatgtttatatgaataaattattagtgtgatctaagcgtgttttcattataattcgccttgccacttcgcttatatatangccg

SEQ ID NO: 336 - DNA, 542 bp, Ctenocephalides felis; identical to SEQ ID NO: 333

SEQ ID NO: 337 - DNA, 542 bp, Ctenocephalides felis
  misc_feature (33)..(33): n = unknown at position 33
cgaaaccataaaaaaatacggcaaactcaatgncctcatcaacaatgccggcatgttggaaacaggcaccatcgagacaaccagtctagaccagtacgacagaatcatgaacgttaacatgagatctgtgtaccatttgacaatgttagcagtgcctcatttgattgagacgaagggaaatattgtgaatgtctcgagtgttaatggtatacgttcttttcctggtgttctggcttataatatatccaaagcggctttggatcagtttacaagatgcgttgctttggaacttgctcttaagcaagttcgtgttaattctgttaatccgggggtcattattactgagatacataaacgggggggaatggatgatgaaacttataaaaaattcttagaacattgcaaaactactcacgccttaggacgtccaggacaagtaagtgaagtatccaatgccattgcgtttcttgcaagcgagcacagcagctttattactggtgcttcgttaccggtgatggaggcagacatgcctgtgcccacga

SEQ ID NO: 338 - DNA, 542 bp, Ctenocephalides felis
  misc_feature (31)..(31): n = unknown at position 31
aaaaaaacaagcttttttaacgaaatatttngcaaaaagagaaatatataaacaaacttaatgtctgaaacaatataaaataatattttcaacgctaacgcttaaataattccaaaacaaatcatgagtgactattttcttttatgttaacctctttacgcaaagaaaatgtttataaacttcaaacaacgttaaggtgataaatgtttacctaataataataataataagtttattttgattttgtgtataaaaacatgtcttggaggctgctgttgaagttttaatttgcaagtgttagatacaacttaataaaaaatgtctcaatgatgacaataacaaaaaattcttttacccaagtgcctcttgtatttataatatgatatacaaaatgcccccgtttagacgtaaaaaatctggaaagtcttttccagttaaagtttgcactttggacgctgagttagaatttaatttggagtggaaagcgacaggcaaagatttattcgaattagtttgccggacgattggttacgagagacctg

SEQ ID NO: 339 - DNA, 542 bp, Ctenocephalides felis
  misc_feature (32)..(32): n = unknown at position 32
agttcatcttatgttgtaattatattatcagnttgttgtaaacacttcttattttatatcataaatatcgctgtatttgatttacacgatggctgcaagattgaattcattgtttaaaacagatttcacaaattacataaaacgtttaaacagcgttcaaatacgttgcttaaatttgcaagaatatcaaagtaaaactctacttcaaaaaagtggcgttgccgttcaagcctttagattattagataacaccgaaaacacaagtgtcttaaatgatttcaaagtccccgaatatgttatcaaggcccaagttttagcaggaggtagaggcaaaggccattttgataatggctttaaaggtggtgttcatataacaaaggaccctaaagaaatattgccaattgctaaaaatatgatgggtcacagacttattacaaaacaaacaaaagctgaaggtatacttgtcaaaaagttatggtgcacaaagcgttgacatttgcgggaaacatattatgtatcatcatggcagagctcatatggcc

SEQ ID NO: 340 - DNA, 542 bp, Ctenocephalides felis
gagaaaagagtggaagaatttaaattaaagaaaatgtggaaaagtcccaatggaactatcagaaatattctcggtggcacagtcttcagagaagcaatcatctgcaagaacataccccgattggtaacaggatggaatgagcccatagtcatcggcagacacgctcatgctgatcaatacaaagccaccgacttcgtggtaccaggaaagggtaaattagaattgacatttacccccgaatcgggaagtccaatgagcttcaccgtccacacttaccaaggacctggagtcgccatgggaatgttcaacaccgatagttcaattgtagatttcgctaatgcctcattccaatatgccttaaaccgaaaattgcccttgtacctatctaccaaaaataccattctcaagaaatacgatggtagatttaaggatatattccaggaaatttatgacaagcaatacaagaaagaatatgaagctgtggaatctggtacgaacatcgactgatcgatgacatggtcgctacgcaatgaaatcatctg

SEQ ID NO: 341 - DNA, 542 bp, Ctenocephalides felis
  misc_feature (533)..(533): n = unknown at position 533
attcctttttttttttttaaatattagtgtaacttttaataaaattatttactcaatatcttaaaattgtttgtgatggcacatgttttataactgttttgaaaatttcgagtcacttcttaaagttaaaatttaattaaagtcagtgtagtggtaataaataaattttggcatcaaattaagtattggatatcatggcgaataataatgtgataaattttggggcaggacccgccaaactcccagaagaggtgatgcttgaagtgcaagaacaattggtgcattatggtgaaacaaaaatcagtgtaatggaaatgagccatcgatcaaaagactacatgaaaatcaacgatgatacacaaaatgcagttaaagaattattcaaataccggacaattcaaaatactatttctgcaaggaggtggcacaggatgtttgcagccataccactgaatattttgaagactggagttgcagattatgttgttacaggttcttggtctgcaaaagctgcaaagaagcaccaaattggnaagtaacat

SEQ ID NO: 342 - DNA, 542 bp, Ctenocephalides felis
  misc_feature (2)..(2): n = unknown at position 2
  misc_feature (33)..(33): n = unknown at position 33
  misc_feature (39)..(39): n = unknown at position 39
cnttaatatactatgaatggtggagaagattgngctcangatgtgaaagagcaagaacaagttaacggtggcggtgaagaaggagccggcgatgcgtctcgtgaaaatggaagcgccgaagctcctggccgtgacgacgataggaaactctttgttggtggacttagttgggaaacaactgataaggaattgcgtgaacactttggtgcatatggagatatcgatagcattaatgttaaaactgaccccagtactggtcgatcacgaggatttgcattcatcgtgtattcatctcctgaatccattgataaagttgttgctgtatctgaacatataattaacaacaagaaagtagatccaaagaaagccaaggcccgccatggaaaaatttttgttggaggtttgacgactgaagtcagcgatgatgatattaaaaactatttcaatcagtttgggacgatcatagaagttgagatgccatttgacaagacgaagaatcaacggaaaggtttctgtttatacttttgaatctgagcaagttg

SEQ ID NO: 343 - DNA, 542 bp, Ctenocephalides felis
aaaatactagttttattgccattaatatttgaaaaatatcattgagaaaatgtcaatattattatgcgcgctattttttgcttcgacgcttagcaatgaaactttgtcgaaacaccatcaagttaagaatcgtcgattttacatagattatgataaaaatacattcatgatggatgacaaaccatttcgatacatagcaggttcattacattattttcgggtacatccgcaacaatggaaagaccgtttggaaaagctaaaagcagcaggtttaaatgccgttgatacatatgttgagtggtcacttcacaattttgatgaaggaaaatattggtggggcagcaacgccgatttggagcaatttattaaaactgcacaagaagtaggattgtatgtaattttgagaccagggccatacatttgcgctgaacgtgattttggaggccaaccttattggctcttatccacccagaaaaagatattaaaccaaggacactgtttcgtatatggaagcagcacgagatggatacaagaatattaaa

SEQ ID NO: 344 - DNA, 550 bp, Ctenocephalides felis
  misc_feature (538)..(538): n = unknown at position 538
cttgaccgccaccgagtctgaagtggctgcactcaacaggaaggtgcaacaaattgaagaagatttggaaaaatctgaagaacgtgccggaagcgctaccaccaaattgcttgaagccacacaagctgccgatgaaaacaaccgtatgtgcaaagtattggagaacccgctcacaacaagatgaagagcgaatggaccaattgaccaaccaattgaaggaagcacgtctcttggctgaagatgctgatggtaaatctgatgaagtatcacgcaagttggccttcgttgaagatgaacttgaagtagctgaagaccgtgttaagggaggtgacagcaagatcatggagttggaagaagaattgaaggttgtaggaaactccttgaaatctttagaagtatccgaagaaaaggccaaccaaagagtagaagaattcaaacgccaattgaagactttgccgtcaaacacaaggaaccgaactcgtgccgagttcgccgaaaagaccgtcaagaactgaaaaggagtcgcaggctgaagacnattggcataaca

SEQ ID NO: 345 - DNA, 550 bp, Ctenocephalides felis
  misc_feature (33)..(33): n = unknown at position 33
  misc_feature (539)..(539): n = unknown at position 539
aatcggtgtagtgcatataggaataaaatactngttttattgccattaatatttgaaaaatatcattgagaaaatgtcaatattattatgcgcgctattttttgcttcgacgcttagcaatgaaactttgtcgaaacaccatcaagttaagaatcgtcgattttacatagattatgataaaaatacattcatgatggatgacaaaccatttcgatacatagcaggttcattacattattttcgggtacatccgcaacaatggaaagaccgtttggaaaagctaaaagcagcaggtttaaatgccgttgatacatatgttgagtggtcacttcacaattttgatgaaggaaaatattggtggggcagcaacgccgatttggagcaatttattaaaactgcacaagaagtaggattgtatgtaattttgagaccagggccatacatttgcgctgaacgtgattttggaggccaaccttattgctcttatcacacccagaaaaagatttaaaccaaggacaactgatttcgtatatggaagngcacgagattg

SEQ ID NO: 346 - DNA, 482 bp, Ctenocephalides felis
caagctgtcaaagtctggcaaatatattttaatttaataatttttgtctgttttaaataaaaaatgtttcggagagcgatttctagtgctactaaattgcacaaacaaactttaggtaatcaaattgtgcaagtcaggaaccatggtggaactgccaattaccgctgtgcttcacgtccttcaaaagaaattaaacttctcggtgaacttactggggctttaatgtggtactggtgcttgtaccatatttggactgaaccggatcatattttaggagagtttccttatcctgatcctagtaaatggacggatgaagagcttggtatcccagccgagtaatgatggatagttaattgatagaaataattaaatattgaaatttaatgaagtatctggattgtatatggtactgcaatttgtatatagaaagtgaataagatgtgttaaacggtagtgaaatggaaaaaaaaaaaaaaaaaaaa

SEQ ID NO: 347 - DNA, 550 bp, Ctenocephalides felis
gctactcattttacgtaacgttttagaagtgtgtgggtgtggtgctaattttagcaccgtagcgatcgtttttattaagttttttttattttgagtaatagttttaatatattttaccaaaatgttgcatcttaagtcaatcaccaaaagtgcactgaaacataacccctccgaagtgtccacattggtcaaagctctgccaacggccatccaaacgcgctcttactccgagcaccaaattcccgataggctgaaggatgtcccaacacatcctaatccaagatttttcgacatggtggagtacttcttccaccgtgcctgccagatcgtcgaatctaaattggtcgaggacatgaaaggaagcaaaatgacagttgaagataaaactaagaaagtcaaaggtattcttatgttaatgcagccatgcgatcacattttggaaattgctttcccattgcgcagagattcaggaaactacgaaatgattcagggttaccgtgctcaacacagcacacatcgacaccaccaaaggaggttccgtttcaatggt

SEQ ID NO: 348 - DNA, 550 bp, Ctenocephalides felis
  misc_feature (523)..(523): n = unknown at position 523
gtcacttgtagcggtttgttcgattataatatttttacgaaacaatgaaagtaatattgagaaacaaataatacaaatgtagttgatttcgtacattttatagcaatcttcacgatggccgccggtccgatagcagaaagaaatcaagatgccactatttatgttggtggtttggacgataaagtctcagaaagtcttatgtgggagctatttgttcaatctgggcctgttgtgaatgtccatatgccaaaagatcgagtaactcaaatgcatcaaggatatggatttgttgaatttctgggagaagaagatgcagactatgcaatcaaaattatgaacatgataaaactttatggaaaaccaattagggtcaataaagcttcagcacatcagaaaaatcttgatgtcggtgccaatgtgtttataggaaatctagacacagaagttgatgaaaaattattgatgacacatttctgttttggagtaattcttcaaacccgaagatatgagggatccaacctgnaatcaaagggtttgcatcataaatttg

SEQ ID NO: 349 - DNA, 550 bp, Ctenocephalides felis
  misc_feature (547)..(547): n = unknown at position 547
ttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaatataaatgattgtcaaagctattattattgtgacgaaaatagtataggaacccaatattattgcccgcaaattttgcatatgatccgttacgtcataattgcggcctatggctctgggcacaaaatgctatacagttacatgtctgccagcctaaggtgcttccgtacattggtgataaatattgacgtcgatgtatggccggaagaggaccgtangca

SEQ ID NO: 350 - DNA, 550 bp, Ctenocephalides felis
cgagtttatattttatttttaataatttaatttatattattgaatgggagattattagaattaattctataataattatttttagaatattatttgattgaatatctttaatatttataagatttgtattaataatttcttcaatagtagttaagtatagagaaagatatataatagaagattttaataaaaatcgatttttattattagtattaatatttgtattttctataataataataattattagtccaaatttaattagaattttattaggttgagatggattaggtttagtttcttattgtttagttatttattatcaaaatattaaatcttataatgctggtatattaactgttttaataaatcgaattggggatgtgctttattaattagaatttcttggataataaattatggtagttgaaattatttattttatataaaatatataataaataatttgaaataatttaattatatttttgatttaatttctgcaataactaaaagagcacaaatccttttcttcttggtaccagctgca

SEQ ID NO: 351 - DNA, 358 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaactaaaaaaaaaaaaaaaaaaaaaaaaaa

SEQ ID NO: 352 - DNA, 500 bp, Ctenocephalides felis
  misc_feature (412)..(412): n = unknown
ttttttttttttgaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaanaaacattgataatattttttacaatctcttcgatcggaaaaaacgttttcacttttgcatgcagttctgcacgagaaagatttgggtc

SEQ ID NO: 353 - DNA, 346 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaactaaaaaaaaaaaaaa

SEQ ID NO: 354 - DNA, 386 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcgattacaaagaaaattcagaagttgctactgaatcattttctaaaacatcgacatgaaaattaataactctttattgttattagattcgatgtaagatatatgt

SEQ ID NO: 355 - DNA, 387 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattagattccgatgtaagatatatgt

SEQ ID NO: 356 - DNA, 492 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcataactatagtaatttctgattatttaaaatatataaatatagaagctttatgaaattaaaaaaaaaaaaa

SEQ ID NO: 357 - DNA, 360 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagttaaaaaaaaaaaaaaaaaaaaaaaaaaaaaaaa

SEQ ID NO: 358 - DNA, 372 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatggttgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaaaaaaaaaaaaaaaaaaaaaaaaaaaa

SEQ ID NO: 359 - DNA, 269 bp, Ctenocephalides felis
gtgttaagtggtatcaaaacttggtcacccagtttatgagagaagtcttaccacaacatttccaaagcatttgtctggtgtagcaaaacatcgtgcccactccatgggctttcgtagacttcagatactgcttccattaaagacttggaagcactttgcacagctctaatacatcttatgtagttattaaattccttttgcagtctattagcactattttgctgcctggtgaagttttgtaaatgctcatcaaaaatatcatctgcggt

SEQ ID NO: 360 - DNA, 353 bp, Ctenocephalides felis
  misc_feature (15)..(15): n = unknown
tttttttttttttgnttttggttcacttgctggtttattagattatgtatttgttcatctataaaactaatagttaagaaaaattatttcaagttacaatttcacacgatgcaattttccacaacatcattaatttcttccaatctggattcccatttattcaaattgtctgaagaacattttcccaaatctaaacgaagttccacgacattcctgagggcttctcctactttaatgccaacatcagttgaaactctggctgctgctagttgtatatttaatgcaaccttttgcatgcatttggccgattcttttcgttccctgaaactcattcttgcaggcaatttatcagt

SEQ ID NO: 361 - DNA, 173 bp, Ctenocephalides felis
cgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagt

SEQ ID NO: 362 - DNA, 379 bp, Ctenocephalides felis
ttttttttttttttttttttttttttttttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgtcgttcagt

SEQ ID NO: 363 - DNA, 173 bp, Ctenocephalides felis; identical to SEQ ID NO: 361

SEQ ID NO: 364 - DNA, 379 bp, Ctenocephalides felis
  misc_feature (57)..(57): n = unknown
  misc_feature (68)..(68): n = unknown
  misc_feature (122)..(122): n = unknown
  misc_feature (250)..(250): n = unknown
ttttttttttttttttttttttttttttttttatatttaattgcacagatcatttgngtatttattanattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgttttatttgccanttgttgttaaccaagaaacattgataatattttttacaatctcttcgatcggaaaaaacgttttcacttttgcatgcagttctgcacgacaaagattttgggtcaaaccattcgttgacgtcgttcagt

SEQ ID NO: 365 - DNA, 237 bp, Ctenocephalides felis
ctgctgctgcaccgggaacaccccctgatactggcgtatcacaaaattgagaattatgttggttcaccaattgtttaacttctttggcaactgctggatcgattgtgctggaatctaagaacaatgtatcttttttggcagatgccaccattcctttgtaacagtctaatactatggcgttgtttggcaacattgtgaccacaaagtcggattttttggcaacttcggcagccgagg

SEQ ID NO: 366 - DNA, 425 bp, Ctenocephalides felis
  misc_feature (377)..(377): n = unknown
tctgtaactaagttgtttagttggaaatcctttatgtgcaacatctacatttaaataaggtttccatcctaaaacacagctagaaaataacccataccatagatccattccatcaccaagagaaacaattcgaccactgggtggtgtaaagaaggactttcctacctgaacaaattgtttggagagtgcatgcctaaatatgatgtcaatacattgcagggcttcctgcggtgtctcaatagatgatccattttccatatattttgaaagggaagtcatgtcaacataagaagcaaatttaatagttactttatattttttttccagttcattatcagggtttataatagaaacctctccttgaagaacatctttangaaggggtgaagaagcatatacattctttactccatcaaatgctgggt

SEQ ID NO: 367 - DNA, 371 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaaaaaaaaaaaaaaaaaaaaaa

SEQ ID NO: 368 - DNA, 269 bp, Ctenocephalides felis
cgcagatgatatttttgatgagcatttacaaaacttcaccaggcagcaaaatagtgctaatagactgcaaaaggaatttaataactacataagatgtattagagctgtgcaaagtgcttccaagtctttaatggaagcagtatctgaagtctacgaaagcccatggagtgggcacgatgttttgctacaccagacaaatgctttggaaatgttgtggcaagacttctctcataaactgggtgaccaagttttgataccacttaacacgt

SEQ ID NO: 369 - DNA, 310 bp, Ctenocephalides felis
  misc_feature (1)..(1): n = unknown
ncataattataagttcaaattattgaactatttttattttggctttcctgcataaaaatataaataattttaagtttaaggtgataatctttcgtaaacccatccattatctgcttcatgtgttaaattcaaatctatttgttcatttggaagcaactttcggaattttattctatcatgtaagcgatcactttggccttgccagaactcaatagatcgaggtattactatatacccgccccagtatggacattcaatcggttgatcatctttgtatttttctttcagttcttgttctttatttataagt

SEQ ID NO: 370 - DNA, 491 bp, Ctenocephalides felis
ttttttttttttttttttttttttttttcgtaaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgaaacattgataatattttttacaatctcttcgatcggaaaaaacgttttcacttttgcatgcagttctgcacgagaaagatttgggcaaaccattcgttgacgtcgtctcacatttca

SEQ ID NO: 371 - DNA, 212 bp, Ctenocephalides felis
  misc_feature (9)..(9): n = unknown
  misc_feature (61)..(61): n = unknown
  misc_feature (184)..(184): n = unknown
aatatcaanttccacaatcgtataccccactaaacgtgaatgcaatgagttgtccactggngctattttattagcaagatatccttccagcattgatcataaaatttacagcgccttttctaccgttttttgtccacgtcaggattttaatatgttgcctggctgctgcagcaggttttatacnacttgctttctctcaagggaactggtta

SEQ ID NO: 372 - DNA, 588 bp, Ctenocephalides felis
  misc_feature (409)..(409): n = unknown
  misc_feature (421)..(421): n = unknown
ggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgtactttgcagactgtactttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtangttcaggagtangtactactcctggtgtgggctcatccaatgatgcaatactcctttatttactgttaaaggcgttccgtcgacattaaactcaccatcataagcggtaacgacagataacgccacaaaactaataaaaaccaatgtgatataaaacattctaataaatatgttaccag

SEQ ID NO: 373 - DNA, 442 bp, Ctenocephalides felis
  misc_feature (243)..(243): n = unknown
  misc_feature (295)..(295): n = unknown
  misc_feature (341)..(341): n = unknown
  misc_feature (402)..(402): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaatgaatgcaaaagtgggattgcnaagtaaggcttaaaccaggaaaacaatcttgaatagactaattaggattcanattatcataaagtagtcaattaatataataaatacacaaatgatcngtgcaattaaatataaaaaatatgtataaaaattaaaatgtataaaattgtattttatgtnaggagcacaaacaaaatgtcattaactatagtaattctga

SEQ ID NO: 374 - DNA, 530 bp, Ctenocephalides felis
  misc_feature (184)..(184): n = unknown
  misc_feature (331)..(331): n = unknown
  misc_feature (447)..(447): n = unknown
  misc_feature (479)..(479): n = unknown
  misc_feature (481)..(481): n = unknown
tttttttttttttttttttttttttctaaaagcttctatatttatatattttaaataatcagaaattactatagttaatgacattttgtttgtgctccttacataaaatacaattttatacattttaatttttatacatattttttatatttaattgcacagatcatttgtgtatttattatantaattgactactttatgacaatttgaatcctaattagtctattcaagattgttttcctggtttaagccttacttagcaatctcacttttgcattcttcgccgggtggcgtgggtatgcatcgcaactccgttttatcaaagtgcaangccatttggacaatcataatgttttatttgccatttgttgttaaccaagaaacattgataatatgtttttacaatctcttcgatcggaaaaaacgttttcacttttgcatgcagtnctgcacggagaagatttgggcacacattcgtngncgtcgtcttcacattcagtagctcggccgcgacacgctaagccgattta

SEQ ID NO: 375 - DNA, 387 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattaagattcgatgtaagatatatgt

SEQ ID NO: 376 - DNA, 417 bp, Ctenocephalides felis
  misc_feature (160)..(160): n = unknown
ttgttgtattccatgcccactgaatccagttgctatatatgtattattgtgatatggatgcaatcctataatgccattttcatcaaaggtattgtattcgtaataaccagcccatgcacttttaactttaattgcttcaaaacatggaacacgatgtgcnaaatgtggccaaacgttttgttcaaaataatccatatctacatctaagttatcgactggcggttctttgtcaggatctggtgaacgaccacagatatatctgccacctaatccatctcttctaaaatatgtatttgttggatcgattgccagaggtgtatttaaacctggaggagaatgatgttgacactcaaagctatacacgtatctttttcttggttccacacgtaaaggaattgacagcaatccttctccagt

SEQ ID NO: 377 - DNA, 229 bp, Ctenocephalides felis
cgtggttttggagtatctgttcaaggtatcatcatctaccgtgcagcatactttggattctatgacaccgctcgtggaatgttgccagaccccaagaacaccccattagttatcagctgggccattgcacaagccgtcacaactgttgctggtattgtgtcatatccattcgacactgtccgtaggcgtatgatgatgcagtctggacgtgcaaagtctgaaatgttgt

SEQ ID NO: 378 - DNA, 356 bp, Ctenocephalides felis
  misc_feature (1)..(1): n = unknown
  misc_feature (6)..(6): n = unknown
  misc_feature (172)..(172): n = unknown
  misc_feature (201)..(201): n = unknown
  misc_feature (204)..(204): n = unknown
  misc_feature (238)..(238): n = unknown
  misc_feature (243)..(243): n = unknown
  misc_feature (247)..(247): n = unknown
nagganactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttantaatgtatagattttgaataataacatanaanttatactatttttttgatgactctaataaaaaanatgtntaantggccatgcctgatatatttttgataaccttaatgaaaaaatgtttaaatggccatgtctgaaaagatttctatgtgtatttttttgttaacattttattgttgaatgg

SEQ ID NO: 379 - DNA, 157 bp, Ctenocephalides felis
  misc_feature (91)..(91): n = unknown
tgtcaagcaaactgaatttgatctgaggtaaaactgaattcaagacataaaagcatcaccaagtatgtatagataaaagataaagattgtnaaaagtttgagaaacactgtttggatggtgaaacaaaatatagaaaacacaaaagttaaaaaatat

SEQ ID NO: 380 - DNA, 498 bp, Ctenocephalides felis
  misc_feature (486)..(486): n = unknown
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaacttttatgcattttcatttctgcatcaataacttatcacaatttttcaattcaataaaactgtagtttgtgttagaactaatcattaaaataatttaggcgtaacttttgattatgttgtaaaaaagcataaacttgtttgatagaaacattacanaattactattta

SEQ ID NO: 381 - DNA, 498 bp, Ctenocephalides felis
  misc_feature (453)..(453): n = unknown
atggaatagtgctaaccaaagcaaagataaaccaatctcgcgtcgcccacatcagtaacggcataagaatcattccactggtccacccgatggactgcatcatggcaatgtgtgctctatcttcacttctggatatttccatcgcaattatcaaagggctttgaaaaacagatgtagatgttagtgaaccaagaaaagccgctgttataaaaacaataaaccaactggaagtaaatgctgtaattagtcttccggtgacgattgtgatgagacttaagtaaaatactggtcttcttccaatcctatctcctaattgtccaaaaataaatgtgcctatgacttcgcccgcacgtccaatagcaaatgtattagttacatagagttctctatcacaaacccagtcttgatctgacggagccgttgataaataccatgttctgtcatattcataancatgctgacaaggtattatttgactttcaatctatttgtctcctc

SEQ ID NO: 382 - DNA, 339 bp, Ctenocephalides felis
  misc_feature (317)..(317): n = unknown
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttggtgcagtctttcggatctgggctgatatcctacaaccgcgcatgtagtttctgccgtcttacagttttcccaaaggttttgatgaccacatatcatctacacaaaatggancatcggaatttgagtctctgca

SEQ ID NO: 383 - DNA, 308 bp, Ctenocephalides felis
  misc_feature (218)..(218): n = unknown
  misc_feature (242)..(242): n = unknown
  misc_feature (249)..(249): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggngaagaatgcaaaagtgagattgcnaagtaangcttaaaccaggaaaacaatcttgaatagactaattaggattcaacttatcataaagta

SEQ ID NO: 384 - DNA, 173 bp, Ctenocephalides felis; identical to SEQ ID NO: 361

SEQ ID NO: 385 - DNA, 390 bp, Ctenocephalides felis
cgatttttttgtttaattttttgcaaaaacaaaagtcagccactttcggcgtgcatcatttataaatgattcgacaaataaccaaattcctcgaagacgtctccgcgagtgcgttaaagttccaacgggaattctacaaggcaaaatcgaaagagttcaggatgctccttcagcagatctcgaggagcaggcaggggacgatttttaagaaacaaccggctctgtggtgtctggtcggatgtctagtaggtggttttagtctggccactctcagcctggcccgcaccgtcaagaatcacccggacgtctacctgatccgcagccactcgggcgaggagcgctactggcgccgatacaccaaactaatcgacgtcagcggatcgcgcaagt

SEQ ID NO: 386 - DNA, 324 bp, Ctenocephalides felis
  misc_feature (301)..(301): n = unknown
  misc_feature (304)..(304): n = unknown
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacanatncataatctaataaaccatca

SEQ ID NO: 387 - DNA, 384 bp, Ctenocephalides felis
  misc_feature (254)..(254): n = unknown
taaaaaatgaaagatctgaccaagtttttgaaccttcggaaactgttatggcctattttgatgacatattacaaaatgaagataccgaatcttccacgtttaaatcgtctcctgaacttcgaaaaagctcttcaaaaagcaataactcatccattaaatcaattagaagtagttcaatatcttccactgaatctagcttactacgtgacggagcgctgaaagattttcccgatacctgtgaaactaaaaatganatcgatatcaaaaatgaagaattcaaagacaacgatgataaagctcactgtcatgacaatattcaaatagttaatcctgcaggactggtgaattctcaatgtgatgattgttataaacccgacactgata

SEQ ID NO: 388 - DNA, 118 bp, Ctenocephalides felis
catcactgagaagaactcttcggctacggaatatcttcattggaggcgcgttgttggtgcacgcagcattaacaaggttcttgcaattcagcataatgaccagaagaaaaatacaggt

SEQ ID NO: 389 - DNA, 498 bp, Ctenocephalides felis
  misc_feature (357)..(357): n = unknown
  misc_feature (363)..(363): n = unknown
aacagttgcatgaactttgcccttcaacgtcattcctaagtatggtgtttctttattcttgtgttggattatgtctttagtgaccttaaattcttcctcgggatcccaaattactaaatcagcatccaagccttctttgatttgtccttttatgccatccagtccagttaatcgagcggccgcccgggcaggtacttgagttccccatccaatcaatgttactgcatcacctttcttgataatatcagcttttcccaaaggaactgtgaaatcatcgacaggaacttcttctacagctgctctgtaaagcgtttttggttccagtagcaaacatggatctttttctctgatcatggntaatanaagacctttggccatatttggacctcttggtatagcaatcttcaatcctgggagtatgtgcaaaatatgcctcaaggctttggggaatgataacaagccccgtgtccgactgccatacaaggtgctcgcactgtt

SEQ ID NO: 390 - DNA, 405 bp, Ctenocephalides felis
  misc_feature (393)..(393): n = unknown
  misc_feature (399)..(399): n = unknown
aagcttttttttttttttttttttttttttcgtatatcatataagttatatttcgtatacattttgtggtttgtggtccatattttaatttgctacttaacatattctatgattatggatttattcaaaattaatttatccaaacagcttataaaattgtatttatcttttatccattcaacaataaaatgttaacaaaaaaatacacatagaaatcttttcagacatggccatttaaacattttttcattaaggttatcaaaaatatatcaggcatggccatttatacattttttttattagagtcatcaaaaaaatagtataatttccatgttattattcaaaatctatacattaataaggatgttagaagtttgttcggttaattttcangcagangttgca

SEQ ID NO: 391 - DNA, 208 bp, Ctenocephalides felis
  misc_feature (67)..(67): n = unknown
  misc_feature (76)..(76): n = unknown
  misc_feature (91)..(91): n = unknown
  misc_feature (96)..(96): n = unknown
  misc_feature (148)..(148): n = unknown
tgaaatgtgaagacgacgtcaacgaatggtttgacccaaaatctttctcgtgcagaactgcatgcanaagtgaaancgttttttccgatcnaaganattgtaaaacatattatcaatgtttcttggttaacaacaaatggcaaataanacattatgattgtccaaatggcttgcactttgataaaacggagttgcgatgcatacccac

SEQ ID NO: 392 - DNA, 359 bp, Ctenocephalides felis
  misc_feature (12)..(12): n = unknown
  misc_feature (68)..(68): n = unknown
  misc_feature (124)..(124): n = unknown
  misc_feature (158)..(158): n = unknown
  misc_feature (183)..(183): n = unknown
  misc_feature (309)..(309): n = unknown
  misc_feature (335)..(335): n = unknown
  misc_feature (357)..(357): n = unknown
tgaaatgtgaangacgacgtcaacgaatggtttgacccaaaatctttctcgtgcagaactgcatgcanaagtgaaaacgttttttccgatcgaagagattgtaaaaaatattatcaatgtttcntggttaacaacaaatggcaaataaaacattatgnttgtccaaatggcttgcactttganaaaacggagttgcgatgcatacccacgccacccggcgaagaatgcaaaagtgagattgctaagtaaggcttaaaccaggaaaacaatcttgaatagactaattaggattcaaattatcataaagtngtcaattaatataataaatacacaantgatctgtgcaattaaatatanaa

SEQ ID NO: 393 - DNA, 380 bp, Ctenocephalides felis
  misc_feature (370)..(370): n = unknown
  misc_feature (373)..(373): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaataaaaaaaaaaaaaaaaanaanaaaaaaa

SEQ ID NO: 394 - DNA, 269 bp, Ctenocephalides felis; identical to SEQ ID NO: 368

SEQ ID NO: 395 - DNA, 173 bp, Ctenocephalides felis
tttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggt

SEQ ID NO: 396 - DNA, 237 bp, Ctenocephalides felis
  misc_feature (19)..(19): n = unknown
  misc_feature (45)..(45): n = unknown
  misc_feature (63)..(63): n = unknown
ctactgctgcaccgggaanaccccctgatactggcgtatcacaanattgagaattatgttggntcaccaattgtttaacttctttggcaactgctggatcgattgtgctggaatctaagaacaatgtatcttttttggcagatgccaccattcctttgtaacagtctaatactatggcgttgtttggcaacattgtgaccacaaagtcggattttttggcaacttcggcagccgagg

SEQ ID NO: 397 - DNA, 229 bp, Ctenocephalides felis; identical to SEQ ID NO: 377

SEQ ID NO: 398 - DNA, 250 bp, Ctenocephalides felis
  misc_feature (134)..(134): n = unknown
  misc_feature (146)..(146): n = unknown
  misc_feature (167)..(167): n = unknown
gatcggttgcaatttgtcattgcaccaagcataaattgatgggtccggtgcataggttataaaagaattgggatttgtgcatttcatgacggtgcaatcagcttctgacgatttctttttacacatatttttanaatgatcatatncatagttaggtgggcattcgnagaacctgacctttaccatctttgcagaataagtatcttgtgcagtctttcggatctggctgatatcctacaaccgcgcatgt

SEQ ID NO: 399 - DNA, 289 bp, Ctenocephalides felis
  misc_feature (3)..(3): n = unknown
aantccgtaaagactgtgccgactgcttaaaacttactgataactaaattagtttaagaattgtataacaaactgtaaacttcctaaaaatgtctagtgatatattatttgtggtctaatggttctagcttatgtagctttttgacaaataaaaattgtttataaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 400 - DNA, 158 bp, Ctenocephalides felis
ctgcatatcaatcagactgtttaggtgcaagcgccacttcttccccatccataccatccttaccatctttcccaaccttgccaacatcttccccaacagcaggatttccttttggccgaaaatctcttgatatgcaaacaaaaactggaactaaatgt

SEQ ID NO: 401 - DNA, 173 bp, Ctenocephalides felis; identical to SEQ ID NO: 361

SEQ ID NO: 402 - DNA, 475 bp, Ctenocephalides felis
  misc_feature (136)..(136): n = unknown
  misc_feature (229)..(229): n = unknown
  misc_feature (369)..(369): n = unknown
  misc_feature (415)..(415): n = unknown
  misc_feature (464)..(464): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacanatggcaaataaaacattatgattgtccaaatggcttgcactttgataaaacggagttgcgatgcatacccacgccacccggcgaagaatgcanaagtgagattgctaagtaaggcttaaaccaggaaaacaatcttgaatagactaattaggattcaaattatcataaagtagtcaattaatataataaatacacaaatgatctgtgcaattaaatataaaaaatatgtatanaaattaaaatgtataaaattgtattttatgtaaggagcacagacanaatgtcattaactatagtatttctgattacttaaaatatataaatatanaagctttatga

SEQ ID NO: 403 - DNA, 369 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaaaaaaaaaaa

SEQ ID NO: 404 - DNA, 209 bp, Ctenocephalides felis
  misc_feature (6)..(6): n = unknown
  misc_feature (183)..(183): n = unknown
gatcgngttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttancatctttgcagaataagtatcttgtg

SEQ ID NO: 405 - DNA, 138 bp, Ctenocephalides felis
taattaattttaaaaaattaaggatagaaaccaacctggcttaaaccggtttgaactcagatcatgtaagaattattggtcgaacagaccaaattttaaaacttctgcattttaaaattatcttaatccaacatcgag

SEQ ID NO: 406 - DNA, 136 bp, Ctenocephalides felis
tccagcatcaccaacgattccaatcgcaaaacccgccgccaagccggaaaatcctacggccaaaccagcgccgagatgtatgaagcccttataaagtgagtaggtttttggttcctccagagcacccgcaatcagt

SEQ ID NO: 407 - DNA, 200 bp, Ctenocephalides felis
  misc_feature (9)..(9): n = unknown
  misc_feature (51)..(51): n = unknown
  misc_feature (65)..(65): n = unknown
  misc_feature (78)..(78): n = unknown
  misc_feature (82)..(82): n = unknown
  misc_feature (165)..(165): n = unknown
  misc_feature (180)..(180): n = unknown
ttttttttntttttttttttttttttttcacttgcaggtttattagattangtcgttgttcatcnataaaactaatanttangcaaaaatatttcaagttacaatttcacacgatgcaattttccacaacatcattaatttcttccaatctggattcccatttantcaaattgtctgaanaacattttcccaaatctaaa

SEQ ID NO: 408 - DNA, 215 bp, Ctenocephalides felis
aaaacccaaaaggcattgtccatgcttcctgcaagcaaagcacattaacattattatcatgagcagcttgtataatattcctagcctttccatacaaagcctctctcatttcagccacaggagtccacgtgttgagtccttcgggtagtgcaaattgcactgctgcaattctaacaactctcgaggctcttgtagattcatggcgagctagaggt

SEQ ID NO: 409 - DNA, 159 bp, Ctenocephalides felis
ctgcatatcaatcaagactgtttaggtgcaagcgccacttcttccccatccataccatccttaccatctttcccaaccttgccaacatcttccccaacagcaggatttccttttggccgaaaatctcttgatatgcaaacaaaaactggaactaaatgt

SEQ ID NO: 410 - DNA, 98 bp, Ctenocephalides felis
  misc_feature (41)..(41): n = unknown
  misc_feature (86)..(86): n = unknown
tacgagtgcacattaaacgctcaaggtgtattcgacgtggncccggatatgcttgtgcagctgagtttatatttcaacagcgttcngcagcattgcgt

SEQ ID NO: 411 - DNA, 367 bp, Ctenocephalides felis
  misc_feature (329)..(329): n = unknown
cttggcatctagttttgtaaattcagtttggctgtttattttgctgcgatatttcaatggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccanaaagtcccaaatttttgatgaatcagggaagaaacgaa

SEQ ID NO: 412 - DNA, 324 bp, Ctenocephalides felis
  misc_feature (14)..(14): n = unknown
  misc_feature (143)..(143): n = unknown
  misc_feature (244)..(244): n = unknown
  misc_feature (260)..(260): n = unknown
  misc_feature (293)..(293): n = unknown
tgaaatgtgaagangacgtcaacgaatggtttggcccaaaatctttctcgtgcagaactgcatgcaaaagtgaaaacgttttttccgatcgaagagattgtaaaaaatattatcaatgtttcttggttaacaacaaatggcanataaaacattatgattgtccaaatggcttgcactttgataaaacggagttgcgatgcatacccacgccacccggcgaagaatgcaaaagtgagattgctangtaaggcttaaaccangaaaacaatcttgaatagactaattaggattcnaattatcataaagtagtcaattaatataata

SEQ ID NO: 413 - DNA, 275 bp, Ctenocephalides felis
  misc_feature (4)..(4): n = unknown
  misc_feature (116)..(116): n = unknown
  misc_feature (182)..(182): n = unknown
  misc_feature (230)..(230): n = unknown
tganatgtgaagacgacgtcaacgaatggtttgacccaaaatctttctcgtgcagaactgcatgcaaaagtgaaaacgttttttccgatcgaagagattgtgaaaaatattatcantgtttcttggctaacaacaaatggcaaataaaacattatgattgtccaaatggcttgcactttganaaaacggagttgcgatgcatacccacgccacccggcgaagaatgcatnaagtgagattgctaagtaaggcttaaaccaggaaaacaatcttga

SEQ ID NO: 414 - DNA, 247 bp, Ctenocephalides felis
taaaccggtatgactattttcttcataaataatgcaatcgggattatccttttcaatatctattactttaactgctgtatcatcagcacaaacagctagaagttttgtgctaaaaatatgaacaataattaacaatatgaacaaagaaattaaagaaaaaacatgatcaaattgtatagaacaatcttgtaaataattatgaaatatagaactatttaaaaaaaaaaaaaaaaaaaaaaaaaaaaac

SEQ ID NO: 415 - DNA, 296 bp, Ctenocephalides felis
  misc_feature (90)..(90): n = unknown
  misc_feature (219)..(219): n = unknown
  misc_feature (226)..(226): n = unknown
aagctttttttttttttttttttttttttttttaaaggtattgaaatttatatttattacatttgtatggctacatatgcttatgttcanaaggttttattagtctttttctatacaatttcaatcaaatatttcatattatagtttttcatttataggatattttcatttatttaacattattatggtcaatatattgttaatgtatcatgggtatancgactanagtgacaaataatttgaatgaaaactggacattaccaatcgaatccaaatattttatgtcacgggaaata

SEQ ID NO: 416 - DNA, 210 bp, Ctenocephalides felis
ggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgt

SEQ ID NO: 417 - DNA, 462 bp, Ctenocephalides felis
  misc_feature (447)..(447): n = unknown
atgaatccaattcggtaaggagcaatcatttcatcatttgaatgcccatcgtgatgctgggtcttccatacagaattcacagttgtatttttaccctcaggacaaccttcagtcgacatatttagataagggaatttcaaattcccttgagcaatattaatttgggctccacttaccatccaactgaccaggattagacttgcagctgctcccaccaaaactcccttagtgttggctttagggaacaaaattcccaatgtaaacattcccaaaagtgttcctgcagtgactccagtaacactgatgaccaaatgcatgacacttcctaattgttctactacgaagacaagcccaaggcaaatgcctccaattactactacagtcaacttcatgatgttactggcagtcttctcagtggtattaaccggtaaccattccttaataaanatcctcgtaaagtgt

SEQ ID NO: 418 - DNA, 378 bp, Ctenocephalides felis
aatctgtaataccaggaatgttaaacaaaaaagtaataacaaagatattgtatttttaaataatattgatcaccttgcattgtaataatactaaacaatctatttacaattaaaaacactccttcacaaatttaattctccttcttgatgcgtgtggatgtcattctgtaaataatggagtcccttccggggtccattgtggagattgagatacagatagctagtagcgagaagaaaaaggctactccgaaccataagatgatgttaaaaaccaccgggtaagagtcgttgtattctttagctaggttgaaatcgggttcttttggagcatcatctgcttgccttgttttacgtgttaggacgtcattggaggttagt

SEQ ID NO: 419 - DNA, 288 bp, Ctenocephalides felis
  misc_feature (4)..(4): n = unknown
  misc_feature (28)..(28): n = unknown
  misc_feature (71)..(71): n = unknown
  misc_feature (109)..(109): n = unknown
  misc_feature (204)..(204): n = unknown
  misc_feature (245)..(245): n = unknown
  misc_feature (252)..(252): n = unknown
atanatcttacatcgaatctaataacantaaagagttattaattttcatgtcgatgttttatgaaaatgantcagtagcaacttctgaattttctttgtaattgataanactttctcaaagtataattgcatttcgcaacacacgacggaaatatggttatggtccatatgaagcaatgctcgttcttctatccacttgcttcngataaatgttcggtataaagaatgcaatcactccacatgcnatcaganatgttcctgatattaaaaatgttaaatcgcaattat

SEQ ID NO: 420 - DNA, 374 bp, Ctenocephalides felis
  misc_feature (299)..(299): n = unknown
tggtattgggagaattaatttgtgtttttaagaaagttcgtcttttttgaataactgaatgaatgagattttttgggtaaccattttcaattagagttatttttactagggataaattttgtggatggaaagtttggtgagacaacaaaatagcatggtctgtaagggaaataatagtgtttatcttatagtttctgggacagtatgaggaatagtgtaagtatctacccgaccatgtcgtttttctataccaatttgttcgaataaagttattagtgttgtaaacggatacatctaanaaattaagtctgttgttattttgtagttcatgtgtgaaaattatattattgttaaaattattgaagagatctagt

SEQ ID NO: 421 - DNA, 396 bp, Ctenocephalides felis
  misc_feature (142)..(142): n = unknown
  misc_feature (272)..(272): n = unknown
  misc_feature (363)..(363): n = unknown
  misc_feature (378)..(378): n = unknown
atattatattcacaataatctaatcttccaagttgcggaatgcttgctgtaaatcctcatgtaattgatcaaaatcactcttgatctttgcctcaccatccttgactgggtccttgaacttcattgaggacaactgatatanaatattgcccatagcatctctaatggtattccaggtaatcttgttttcactttgtgcagtagattcaactgcgtattttgccatatcatagaaagcaataatgttacgtaacataccaactgttttatanaaggggcagaaacgatcatatgatgagtagctgttctgctgtaggaaatcgtctttcaagagcttggcaacttcaagtgtgatcttgtcangtttccgccaaggangctttaccaaccaattgt

SEQ ID NO: 422 - DNA, 381 bp, Ctenocephalides felis
atgcaatgagtgtttttttcatgtgctcacccataaacagcggagcagtttgatcccatacagttcttaaaaatgatttctttgttttatttgtattttcaccatccactcctggatattcatctaagattgatgatacggggaattcactttctggtttaccagtattaattctatacattttggcaataatttgacgagcttcttcgtttcttccctgattcatcaaaaatttgggactttctggtaatttccacaaagcaaagacaacaaagcagtgatggcaaaccacatgcaaccatatacaacctccagggcttgtatgtatatcccaaaaagtcaatatagaatgaccatttctgatttataattaaccatgca

SEQ ID NO: 423 - DNA, 370 bp, Ctenocephalides felis
ttctgataacaaaaggccctgtggataaagtctccatccctgttccgttacaatgtgtacatttgacaggctttgtgccaggctcacacctggaacctctgcatttctgacaagtatctactatgttgacattaatatctttattaactcctcgtgcagcttgagagaatgttagtttcatagatacttcttttgcaccaccaaatccaaaactggattcagcaaagtcatcaaaacctccagttttaaatcctgcatcaccaaatattttgtgaaatagttcttcagggtcgattgtcgattgatacttccaactctgtgagaagccttgagggcctgctccccccatgccgcccatctgttcagaggt

SEQ ID NO: 424 - DNA, 166 bp, Ctenocephalides felis
atagctgatcctgacatacgttcagctgttacgacaggaccagaaacggcgtatacatagccgaattttccctctcgctcttcatccgagattttattaagttcttgaggcattttggctcctttggttatttgtcgttttaaaacacactctgatcctgttcgaa

SEQ ID NO: 425 - DNA, 427 bp, Ctenocephalides felis
aggaagttcctaccacaattcaaatggaaatgtatacgaagtaaccgacatagttttacatccgaaatttaatataaggacctttgactatgatgtcgctctggttaaagttaaaaatcctattaaacttacagtgtgtaatagtcgacctgtaaatttagctaatgagcaatatgagactcctgtaggatctttagtttatgtaacaggatggggagctaaccagaccgaaggaaacgattcttcagaattacttggtgcttggattcctctgatagattcttcagcatgtcaaagtaattatgcagaaccaggaaaaccagacagaatcactgatagaatgttatgtgctggttctgcaaaaggtgacggtttttgtcacggtgattatggtggtccattagttgacaaaaacaggaaacttata

SEQ ID NO: 426 - DNA, 498 bp, Ctenocephalides felis
ggccctggacaagatgcccttcgactcaccaccgaatatggagctgtctacgatcaaaatgccaccattgaagttcttaataaacagaagaggaaaactttgtgccacactgatggcgaaggagttgaatgcgaaacagaagaagggagcatcgcacctcaaataatactatttgttgcccaattaatttctggagtcggtggatctttatactacactttaggtgtatcctatatggacgataacaccaaaaaatctaaaacaccagcactgatgagtttttcttattttcttcgtatgctcggacctgcaaccggttatgccttggctagcgtctgtctaaagttctacatttcgccaacgttgacgccaacaattgataataatgatcctagatggttaggagcatggtggttaggttggttgatactaggatcaactttaatattttttgcaacgttgattggattgtttcctaaaatctgccaagagctgcaa

SEQ ID NO: 427 - DNA, 191 bp, Ctenocephalides felis
caagttgctacattcaaaggattacaaacagaaaatgtagatgcaagccaagagtagattgtaattatttcataaaataaattaaaatcgcaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaa

SEQ ID NO: 428 - DNA, 173 bp, Ctenocephalides felis; identical to SEQ ID NO: 395

SEQ ID NO: 429 - DNA, 173 bp, Ctenocephalides felis; identical to SEQ ID NO: 361

SEQ ID NO: 430 - DNA, 138 bp, Ctenocephalides felis
  misc_feature (92)..(92): n = unknown
taattaattttaaaaaattaaggatagaaaccaacctggcttaaaccggtttgaactcagatcatgtaagaattattggtcgaacagaccanattttaaaacttctgcattttaaaattatcttaatccaacatcgag

SEQ ID NO: 431 - DNA, 481 bp, Ctenocephalides felis
  misc_feature (460)..(460): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataantatagaagctttatgaaatta

SEQ ID NO: 432 - DNA, 368 bp, Ctenocephalides felis
  misc_feature (58)..(58): n = unknown
  misc_feature (179)..(179): n = unknown
  misc_feature (210)..(210): n = unknown
  misc_feature (238)..(238): n = unknown
gtattcaatggtatgaattgcttggtgaatgaaaatttcactcatgggttcttcttcntgttctccatgagctgcttttggcggtgcctttggtgcctctggcataccgttttcttggctggagacaacgtctgaagtcatttccattccttggtttaaatcaccatttgatttagcanaatgaggagcttcatctttatttttcttggntgccatcaaatataatggtttgcctaanagcatgagcggaatacagcagagcccaattaacacaaatattttttgaatttgctgttgtccttcaaacataaattcatcgcattgttctgctggagatccttgcttgaataacatcatgttaatgaaca

SEQ ID NO: 433 - DNA, 119 bp, Ctenocephalides felis
catcaccgaagaagaactcttcggctacggaatatcttcattggaggcgcgttgttggtgcacgcagcattaacaaggttcttgcaattcagcataatgaccagaagaaaaatacaggt

SEQ ID NO: 434 - DNA, 364 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaacgtaaaaaaaaaaaaaaaaaaaaaaaaaaaaaaa

SEQ ID NO: 435 - DNA, 500 bp, Ctenocephalides felis
  misc_feature (219)..(219): n = unknown
  misc_feature (418)..(418): n = unknown
  misc_feature (436)..(436): n = unknown
ttttttttttttttttttttttttaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatccnaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatngggaaaaacgttttcacntttgcatgcagttctgcacgagaaagatttgggtcaaacaatcgttgacgtcgtctcacattca

SEQ ID NO: 436 - DNA, 221 bp, Ctenocephalides felis
tatataatctgattctcgatttgtatcttcataactgattctcagatatccattaccggaatgttcatcattacgtctgagttgtccactaaattcaactttttttccattttcttccatgacatgtctgaattttattttaccatcaactaaagattccatgtgagctcttgcgcaagttccatctcgttcaaaatgattttggtatctatattgttcgt

SEQ ID NO: 437 - DNA, 498 bp, Ctenocephalides felis
  misc_feature (299)..(299): n = unknown
  misc_feature (327)..(327): n = unknown
  misc_feature (488)..(488): n = unknown
  misc_feature (495)..(495): n = unknown
aataaatcatggtctgaagagacaaataagattgaaagtcaaataataccttgtcagcatggttatgaatatgacagaacatggtatttatcaacggctccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgtcaccggaagactaattacagcatttacttccagttggtttantgtttttataacagcggcttttcttggntcactaacatctacatctgtttttcaaagccctttgataattgcgatggaaatatccagaagtgaagatagagcacacattgccatgatgcagtccatcgggtggaccagtggaatgattcctaagccgttactgatgtgggcgacgcgagattgggttanccttgcnttg

SEQ ID NO: 438 - DNA, 95 bp, Ctenocephalides felis
tacgagtgcacattaaacgctcaaggtgtattcgacgtggcccgatatgcttgtgcagctgagttatatttcaacagcgttctgcagcagtgcgt

SEQ ID NO: 439 - DNA, 486 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggaacacaaacaaaatgtcattaactatagtaatttctgattatttaaaatatataaatatagaagcttatgaaaaaaaaaaaa

SEQ ID NO: 440 - DNA, 498 bp, Ctenocephalides felis
ccttactgatcctcgatttgattggaaaattgatattgataataataaaccaataaatataccaaaacccaatctagtcaaccatataacattcaacatcctccatttgtccgatatacattatgatccaaagtatgaagaaggaaaaaatgccttatgtggacaatcagcctgctgcaggaatgatcaagggcctcctgatcataaggaggatggtgcaggaaggtggggcgactacaggggatgcgatacgcccaagaaggcgatggaagatgctattcagcatataaaatataaacaccgggatatcgattttgcttattttactggagatatgatagatcatgccatgtgggaaacatcgaccgaaagcaatataaaaacaatgaaagaagtgttaattgctatttatccactagctcctaaattatatccagttttgggtaatcatgaatcacatcccgccaatttattttctcaacaaatgttactgatgcg

SEQ ID NO: 441 - DNA, 269 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 442 - DNA, 386 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaggaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattagattcgatgtaagatatatgt

SEQ ID NO: 443 - DNA, 500 bp, Ctenocephalides felis
  misc_feature (488)..(488): n = unknown
tttttttttttttttttttttttttttttttttgatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagatttggggtcaaaccantcgttgacgtcg

SEQ ID NO: 444 - DNA, 500 bp, Ctenocephalides felis
  misc_feature (210)..(210): n = unknown
  misc_feature (222)..(222): n = unknown
  misc_feature (290)..(290): n = unknown
  misc_feature (354)..(354): n = unknown
  misc_feature (374)..(374): n = unknown
  misc_feature (427)..(427): n = unknown
  misc_feature (464)..(464): n = unknown
  misc_feature (468)..(468): n = unknown
tttttttttttttttttttttttttttttttatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttangataatttgaancctaattagtctattcaagattgttttcctggtttaagccttacttagcaatctcacttttgcattcntcgccgggtggcgtgggtatgcatcgcaactccgttttatcaaagtgcaagccatttggacaancataatgttttatttgccanttgttgttaaccaagaaacattgataatattttttacaatctcttcgatcggnaaaaacgttttcacttttgcatgcacttctgcacganaaanatttgggtcaaaccattcgttgacgtcgtctt

SEQ ID NO: 445 - DNA, 173 bp, Ctenocephalides felis; identical to SEQ ID NO: 395

SEQ ID NO: 446 - DNA, 498 bp, Ctenocephalides felis
tgaaatgtggagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgtatctttttaata

SEQ ID NO: 447 - DNA, 500 bp, Ctenocephalides felis
  misc_feature (376)..(376): n = unknown
  misc_feature (390)..(390): n = unknown
  misc_feature (407)..(407): n = unknown
  misc_feature (442)..(442): n = unknown
  misc_feature (467)..(467): n = unknown
tttttgaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataangttttatttgccanttgttgttaaccaaganacattgataatattttttacaagtctcttcgatcngaaaaaacgttttcacttttgcaancagttctgcacgagaaagatttgggtcaaacca

SEQ ID NO: 448 - DNA, 271 bp, Ctenocephalides felis
  misc_feature (105)..(105): n = unknown
  misc_feature (139)..(139): n = unknown
  misc_feature (191)..(191): n = unknown
  misc_feature (194)..(194): n = unknown
  misc_feature (202)..(202): n = unknown
ttttttttttttttttttttttttttttggaacgtcttctaacagtttttcggcaatttcatgtgatggttgattacttgaagttacgtcagtagcttctttcanggcgtcagtaatttgcgattttgaaacatcgccnaccttcggcaattctataacagtggttgattcgagaggttgaaattgtttcntanttttgtcntttttatttttctttgttttgtcagttgtctcttccataactttgtcattgcccttctttgaaggttga

SEQ ID NO: 449 - DNA, 385 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattagattcgatgtaagatatatg

SEQ ID NO: 450 - DNA, 223 bp, Ctenocephalides felis
aattgcgaagtctggaactaaagccttcatggaagccttacaagctggagccgatattagtatgattggtcaatttggtgttggtttctactcggcctatctcgttgctgataaagtcacggtcacatctaagcacaatgatgatgaacaatacctttgggaatcttccgcaggaggttccttcacagttaagactgacaactctgaacccctcggccgtggt

SEQ ID NO: 451 - DNA, 345 bp, Ctenocephalides felis
  misc_feature (53)..(53): n = unknown
  misc_feature (110)..(110): n = unknown
  misc_feature (115)..(115): n = unknown
  misc_feature (165)..(165): n = unknown
  misc_feature (322)..(322): n = unknown
ttttttttttttttttttttttttttttttttaattaattacaaaggaacggnccaaacgatttatttttattaaaaagatacatgtaatttcataaagcttctataggntatanagttttaaataatcagaaattactatagttaatgacattttgtttgtgcnccttacataaaatacaattttatacattttaatttttagacatattttttatatttaattgcgcagatcatttgtgtatttattatattaattgactactttatgataatttgaatcctaattagtctattcaagattgttttcctggtttaagccntacttagcaatctcacttttgca

SEQ ID NO: 452 - DNA, 375 bp, Ctenocephalides felis
cgtcaagtccaatccaaaagtggaagctttttcaggaaagttactaagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatacagcattcatttaaaaaaaaat

SEQ ID NO: 453 - DNA, 411 bp, Ctenocephalides felis
  misc_feature (16)..(16): n = unknown
  misc_feature (81)..(81): n = unknown
  misc_feature (123)..(123): n = unknown
  misc_feature (216)..(216): n = unknown
  misc_feature (229)..(229): n = unknown
  misc_feature (238)..(238): n = unknown
  misc_feature (256)..(256): n = unknown
  misc_feature (260)..(260): n = unknown
  misc_feature (287)..(287): n = unknown
  misc_feature (392)..(392): n = unknown
tttttttttttttttntttttttgaacggcccaaacgatttatttttattaaaaagatacatgtaatttcataaagcttcnatatttatatattttaaataatcagaaattactatagttaangacattttgtttgtgctccttacataaaatacaattttatacattttaatttttagacatattttttatatttaattgcacagatcaggttgngtatttattatantaattgacnactttatgataatttgantccnaaatagtctattcaagattgttttccnggtttaagccttacttatcaatctcacttttgcattcttcgccgggtggcgtgggtatgcatcgcaactccgttttatcaaagtgcaagccatttggacaatcanaatgttttatttgccattt

SEQ ID NO: 454 - DNA, 490 bp, Ctenocephalides felis
  misc_feature (483)..(483): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattaanaaaaaaa

SEQ ID NO: 455 - DNA, 437 bp, Ctenocephalides felis
cacgattcaatatcgacgatttcaaaatttgctgcgttgactttataaattttataattcggatttcggttaacgtaagttgtaatacttcctccattgaatgcaacattaataggatgtgatgaattcatagaatcatagaaaatcttaaattcgtcattatgtgtgtggccattgaattgtcctgttattatatgcgaaaatctttggatgatgcgcctatattctctgtcccaagtaatgaagttagtgggttcaccaggaggaacatgtcccaaaatgtgcactttttcattagttctttctgcttctaacagagtatcatgtaaccattgcaattgctttttggggaatgcaggatcatacagtaaccacaaattataaatataggccacattattattcaacgctatgactcgtagtccaagtttaggtgt

SEQ ID NO: 456 - DNA, 434 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgtacatctgtgatttttagtaacattttatgtatacaaatataatgcactcattttaagaattaggattaaaaggcttccaaatttttttttgcgaaaaatgtatcatataaaattaattaattcgtatttgtaagttaatgtaaataaaatacagaaaagttatca

SEQ ID NO: 457 - DNA, 133 bp, Ctenocephalides felis
  misc_feature (6)..(6): n = unknown
ctgtangtgaagaattattaggcagagtagttgatgctttaggaaatgccattgatggcaaaggtgctttacaaagcaaaaccagattccgtgtaggaactaaagctcccggtatcattccacgtgtctctgt

SEQ ID NO: 458 - DNA, 386 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgtaattatactttgagaaagtattatcaattacaaagaaaattcagaagttgctactgaatcattttctaaaacatcgacatgaaaattaataactctttattgttattagattcgatgtaagatatatgt

SEQ ID NO: 459 - DNA, 491 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattaaaaaaaaaaa

SEQ ID NO: 460 - DNA, 500 bp, Ctenocephalides felis
  misc_feature (461)..(461): n = unknown
tttttttttgaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcgggaaaaacgtttcacntttgcatgcagttctgcacgagaaagattttgggtcaaa

SEQ ID NO: 461 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaaaaaaaaaaaaaaaaaaaaaa

SEQ ID NO: 462 - DNA, 105 bp, Ctenocephalides felis
caagattggccgctgatgtaggtaaaggcgctggtcaacgtgaattctctggattgggcaactgcttgaccaaaatcttcaagtctgatggtctccctggattgt

SEQ ID NO: 463 - DNA, 462 bp, Ctenocephalides felis
  misc_feature (71)..(71): n = unknown
  misc_feature (156)..(156): n = unknown
  misc_feature (184)..(184): n = unknown
  misc_feature (399)..(399): n = unknown
  misc_feature (406)..(406): n = unknown
  misc_feature (434)..(434): n = unknown
tttttttttttttttttttttttttttgtttactatataagttatatttcgtatacattttgtagttccanatttcaatttgctacttaacatattttataattatggatttattcaaaattaatttaatccaagagcttatgaaattgtatttancttttagccattcagcaataaaaggtantaaaaaatacacatagaaatcttttcaggtatggccatttatacatttttttattacagtcatcaaaaaaatagtatttctatgttatttttcaaaatctatacattgataagggttagaaatttgttcggttaattttcaggctgaggttgctactgtagtaatagaacaattttaataatctaaaatttgattaatctattacatttaatcantcaatantaaatttccttttggaatttcgaatggntgtccattacggtaaacaaagtctcctc

SEQ ID NO: 464 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgtatctttttaata

SEQ ID NO: 465 - DNA, 333 bp, Ctenocephalides felis
  misc_feature (281)..(281): n = unknown
tttttttttttttttttttttttttttttggtttatttataaataactttaggtgtccgccactaggggacttccccctacatttagaagtccgtattatttcttacttttaattttattttcttcatttttatattaactctatatctttatctatctatctattagttcaaccaataaaattaagcgtaaaatgaataattttgattagaacaaatatattcatggatttaaaaaaatctaaattgtaaaattcttaaatgccttatcatatttgcgancctgtgttcaaccataatatttttttatataacacataaagtaaaacaaagt

SEQ ID NO: 466 - DNA, 492 bp, Ctenocephalides felis
ttttttttttttttttttttttttttctttcaaagcattttatttttgttttaaaatacataagcattgataaatataaagatagttttatacgagcttaagcttctttataagttacaaattaccaggtatatcaaaataagaaaaataagtaaactattaatacaatacaaaaaaaaacataaaaatttgaaaacttaatactaatatgaagcattagacattacaatttaataatacataaattttaaaaagaatttaataaaattatttatgacgtgccattctttgatgacatggcatttgttgatgactttcaattttcaacttctgacatctcagtgatggtatcgttgatatcgagaagctgttggatatatgattgatcgctcaatatgcttgataatgacgatagcagctttgttagctctgaactagacattcttaattgtgaactgcactcattgatctgatgttgaagttgctctggta

SEQ ID NO: 467 - DNA, 143 bp, Ctenocephalides felis
taattaattttaaaaaattaaggatagaaaccaacctggcttaaaccggtttgaactcagatcatgtaagaattattggtcgaacagaccaaattttaaaacttctgcattttaaaattatcttaatccaacatcgaggtcgc

SEQ ID NO: 468 - DNA, 386 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattagattcgatgtaagatatatgt

SEQ ID NO: 469 - DNA, 269 bp, Ctenocephalides felis; identical to SEQ ID NO: 441

SEQ ID NO: 470 - DNA, 500 bp, Ctenocephalides felis
  misc_feature (408)..(408): n = unknown
  misc_feature (425)..(425): n = unknown
  misc_feature (429)..(429): n = unknown
tttttttttttttttttttttttttttttttaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttanttgccatttgtggttancaangaaacattgataatatttttacaatctcttcgatcggaaaaaacgttttcacttttgcatgcagttctgca

SEQ ID NO: 471 - DNA, 118 bp, Ctenocephalides felis
ctgtatttttcttctggtcattatgctgaattgcaagaaccttgttaatgctgcgtgcaccaacaacgcgcctccaatgaagatattccgtagccgaagagttcttctcggtgatggt

SEQ ID NO: 472 - DNA, 488 bp, Ctenocephalides felis
aattgtgtattattattattatttggtatattattgatataataattgtcttaaaatatatcactacagcgcgctatcatcgactagtgcattatcataataaataagcatctgcactataaagcttaatgattatttgctgatttcgattttgaactaattgaaaaaattaactggaacttttcccagattgaaatcacttcatttaagacaattacaaccatttttaaggaggtatttggctatgatttgtctcctggcaaaacaaaggggcggcatatattacataatcctataactatagaaaagcaaatttaattgtaaataattttaagagattataaaagaattcatatattttgttttgcataatcttacagtgatagaagaaattatacaaattttgtgtgatttagtgcaaaattatcttttaaaaaaatataagtgataagaaatttaatatatttaattaaatttatatctgctgt

SEQ ID NO: 473 - DNA, 269 bp, Ctenocephalides felis; identical to SEQ ID NO: 441

SEQ ID NO: 474 - DNA, 500 bp, Ctenocephalides felis
  misc_feature (297)..(297): n = unknown
tttttttttttttttataattaattacaaaggaacggccctaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggnttaagccttacttagcaatctcacttttgcattcttcgccgggtggcgtgggtatgcatcgcaactccgttttatcaaagtgcaagccatttggacaatcataatgttttatttgccaattgttgttaaccaagaaacattgataatattttttacaatctcttcgatcggaaaaaacgttttcacttttgcatgcagttctg

SEQ ID NO: 475 - DNA, 311 bp, Ctenocephalides felis
tttgttttactttatgtgttatataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaagatatagagttaatataaaaatgaagaaaataaaattaaaagtaagaaataatacggacttctaaatgtagggggaagtcccctagtggcggacacctaaagttatttataaataaatcaaaaaaaaa

SEQ ID NO: 476 - DNA, 438 bp, Ctenocephalides felis
  misc_feature (79)..(79): n = unknown
  misc_feature (88)..(88): n = unknown
aggagactttgtttaccgtaatggacaaccattcgaaattccaaaaggaaatttactattgaatgattaaatgtaatanattaatcanattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgcgtatttttttgttaacattttattgttgaatggataaaagataaatacaattttataagctgtttggataaattaattttgaataaatccataatcatagaatatgttaagtagca

SEQ ID NO: 477 - DNA, 484 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattaccataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttataaaaaaaaaa

SEQ ID NO: 478 - DNA, 434 bp, Ctenocephalides felis
gaggagactttgtttaccgtaatggacaaccattcgaaattccaaaaggaaatttactattgaatgattaaatgtaatagattaatcaaattttagattattaaaattgttctattactacagtagcaacctcagcctgaaaattaaccgaacaaatttctaacccttatcaatgtatagattttgaaaaataacatagaaatactatttttttgatgactgtaataaaaaaatgtataaatggccatacctgaaaagatttctatgtgtattttttattaccttttattgctgaatggataaaagataaatacaatttcataagctcttggattaaattaattttgaataaatccataattataaaatatgttaagtagcaaattgaaatatggaactacaaaatgtatacgaaatataacttatataataaa

SEQ ID NO: 479 - DNA, 173 bp, Ctenocephalides felis
tttctttagtggtgcactgtagatatccactttgatcagcgcacacttgatctgggctacaggattccttaaccggatctgctcctatttccggacaatactgcatttcgggtgaactgcatgaattcacgcaactaaattttacttttttacatttttgctcgggtttcggt

SEQ ID NO: 480 - DNA, 415 bp, Ctenocephalides felis
  misc_feature (16)..(16): n = unknown
  misc_feature (401)..(401): n = unknown
  misc_feature (410)..(410): n = unknown
acacaattatcaatangaaaatctagccacaaatatttttaacaatttatttaatacttatgttctagaaatacaaagtgtaaagttcaaggtttgtatagcttaataaagtaaacattttaaaatgtaatgaatttatctgcaaatagtcaaaatcaaaattactactataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatatantataacatnacggt

SEQ ID NO: 481 - DNA, 500 bp, Ctenocephalides felis
  misc_feature (40)..(40): n = unknown
  misc_feature (257)..(257): n = unknown
  misc_feature (352)..(352): n = unknown
  misc_feature (401)..(401): n = unknown
  misc_feature (426)..(426): n = unknown
  misc_feature (443)..(443): n = unknown
ttttttttttttttttttttttttttttttttaatttcanaaagcttctatatttatatattttaaataatcagaaattactatagttaatgacattttgtttgtgctccttacataaaatacaattttatacattttaatttttatacatattttttacatttaattgcacagatcatttgtgtatttattatattaattgactactttatgataatttgaatcctaattagtctattcaagattgttttcctggnttaagccttacttagcaatctcacttttgcattcttcgccgggtggcgtgggtatgcatcgcaactccgttttatcaaagtgcaagccatttggncaatcataatgttttatttgccatttgttgttaaccaagaaacattganaatattttttacaatctcttcgatnggaaaaaaggtttcacntttgcatgcagttctgcacgagaaagatttgggtcaaaccattcgttgacgtcgtct

SEQ ID NO: 482 - DNA, 498 bp, Ctenocephalides felis
aaaacttcaaagaacattccatccaatggattttcaaacattctcatcatacggtagtttgatataggaaaattaacaaatacaataacaatatattaaactattcatattagttatactatttatttcttaatccacaagttcagagacttcagtaattgtagcatctgctaacatgccttttttgtcaccagttattacatgaccaacaataaaagctttttgcttttcaagctcataaatctctttaatatatccttctgcatctgcttttggtaaagctattaataggcctcctgaagtttctggcaaatatccttctgctagcttaaacattttgctgaagattttggcaacttcggaacatttgtaaaaaactggtagtttattcaatacaaatgaaacattatttttctgattctgggccaaattatcagcatgaccgagaattccaaagcctgtgacatcagtagcaccatgagcattatatttatgcaa

SEQ ID NO: 483 - DNA, 423 bp, Ctenocephalides felis
  misc_feature (333)..(333): n = unknown
taattacttataaaacttgttatatgacacgtgttttgcaatatgtgactatcattttcccataaatgttttgtaatgtaaaaatgtaaatttatgaaaagttttaaatcaaaaactctcattttttttaaaagaaggaacattgaaaataacgatgctggatacaaatcccaggggcaaaaactataacactaattgaaaatctaattttttacactcgcaaactgcagaattaatatgtattcgagtgggacgagctaattgtatcaatattcaacaataaccgattttcaataatattgatctccattgagattaaacaataagtcatanatgaataccattaaaaatgatctgtttactgttttatatatgtaataaaacttggaaagtaacaataaaataaattattgataatcaaca

SEQ ID NO: 484 - DNA, 403 bp, Ctenocephalides felis
tgttatgaaacaagaatgtaacagcgacgcaacaaacgcgaaacaaagccattaagttaattgttacattgttatatttatattattttgacgcaattatattttctatgtttggataataatattttttgtaaattaagtttatgatgaacttagttctgttacgtaacaaaaaggtaacattgtagtaacatataaaatacaaagtgtcatagttgttattattttgataactttatatagatttagtgttatttaaaagttatttgtatatatattaataaaaaaattcaaaggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 485 - DNA, 498 bp, Ctenocephalides felis
  misc_feature (483)..(483): n = unknown
  misc_feature (491)..(491): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattaanaaaataanaaaaaac

SEQ ID NO: 486 - DNA, 354 bp, Ctenocephalides felis
ttttttttttttttttttttttttttgttgataaaacacaaatttattttacatgttaaaaattcttataaagtaaatacatcatccagttacacacgtatttatatatccatataactcgacaaagtagctttacacaatttggaaattgcaatgtgttaaaactaattgttttttagaactatattatattatattttggggaatattaaagttacggacctacaaaattaagactatgtaatgtattcttctttagccactgacaaatttaaataataaatcttgcttcgataagtaatttgaactaatatcgatgacttcctttcgtttttgaaaactaaaaactcttgt

SEQ ID NO: 487 - DNA, 388 bp, Ctenocephalides felis
  misc_feature (29)..(29): n = unknown
  misc_feature (33)..(33): n = unknown
  misc_feature (60)..(60): n = unknown
  misc_feature (101)..(101): n = unknown
  misc_feature (279)..(279): n = unknown
  misc_feature (311)..(311): n = unknown
  misc_feature (380)..(380): n = unknown
gaggagactttgtttaccgtaatggacanccantcgaaattccaaaaggaaatttactantgaatgattaaatgtaatagattaatcaaattttagattantaaaattgttctattactacagtagcaacctcagcctgaaaattaaccgaacaaatttctaacccttatcaatgtatagattttgaaaaataacatagaaatactattttttgatgactgtaataaaaaaatgtataagatggccatacctgaaaagatttctatgtgtattttttantaccttttattgctgaatggataaaagataantacaatttcataagctcttggattaaattaattttgaataaatccataattataaaatatgttaagtancaaattga

SEQ ID NO: 488 - DNA, 498 bp, Ctenocephalides felis
  misc_feature (346)..(346): n = unknown
  misc_feature (358)..(358): n = unknown
  misc_feature (368)..(368): n = unknown
  misc_feature (393)..(393): n = unknown
  misc_feature (413)..(413): n = unknown
  misc_feature (439)..(439): n = unknown
  misc_feature (455)..(455): n = unknown
  misc_feature (475)..(475): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcanttaactataaanaatatgtatnaaaattaaaatgtataaaaatgtantttatgttagggagcacaancaaaatgtcataactatagtaattcngattaattaaaatatntaatatagaagcttatgaantacatgtaccttttaataaaata

SEQ ID NO: 489 - DNA, 324 bp, Ctenocephalides felis
  misc_feature (92)..(92): n = unknown
  misc_feature (115)..(115): n = unknown
gtgccggacgcgtcaaataaactaaattacatttaatttactaataaacatttgatcattattttaatgtcaataatgtgcattttacatcnaataatttgaaatcattaatggncataaatcttcgaaaagttgatggcacttcatgcttcaaatcgccaacgacataacaagctcaagatgcaatattaaactatgttgtaaacataaaatatattattgaaattttataaagaggacttttataatcgctcaaagtttgacttaatataatataaattatttctctttaatatatttttatattttaaagaaaatgtatgt

SEQ ID NO: 490 - DNA, 229 bp, Ctenocephalides felis
aacatttcagactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggt

SEQ ID NO: 491 - DNA, 401 bp, Ctenocephalides felis
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaatt

SEQ ID NO: 492 - skipped

SEQ ID NO: 493 - DNA, 261 bp, Ctenocephalides felis
  misc_feature (38)..(38): n = unknown
  misc_feature (59)..(59): n = unknown
  misc_feature (73)..(73): n = unknown
  misc_feature (75)..(75): n = unknown
  misc_feature (78)..(78): n = unknown
  misc_feature (84)..(85): n = unknown
  misc_feature (95)..(95): n = unknown
  misc_feature (111)..(111): n = unknown
  misc_feature (122)..(122): n = unknown
  misc_feature (140)..(140): n = unknown
  misc_feature (161)..(161): n = unknown
  misc_feature (196)..(196): n = unknown
ttttttttttttttttttttctaatttcataaagcttntatatttatatatggtaaatnatcagaaattactntngtnaatgannttttgtttgngctccttacataaaanacaattttatncattttaatttttatacntattttttatatttaattgcncagatcatttgggtatttattatattaattgactnctttatgataatttgaatcctaattagtgtattcaagattgttttcctggtttaagccttactta

SEQ ID NO: 494 - DNA, 220 bp, Ctenocephalides felis
tgaaggtcccagacccatacaccagattagaggtgatgatgacttgcgatcgtcatatgcatccatgcggtctgggggccgagattcaggccttggaggtctaggtagagatcacagagaccatcgtgactcagaccaggattcatggatgggtggtttgccattgaaactgagaggcattaatgacatgttcaatggactaaatgtgtctagtcccagt

SEQ ID NO: 495 - DNA, 118 bp, Ctenocephalides felis
  misc_feature (37)..(37): n = unknown
  misc_feature (68)..(68): n = unknown
ttttttttttttttttttttttttttccgacaatttnacttgtatttatctgaaacatatttacagtntttcctcaaaaactgttaaatacaataagttaacttaaatacatggatgt

SEQ ID NO: 496 - DNA, 269 bp, Ctenocephalides felis; identical to SEQ ID NO: 441

SEQ ID NO: 497 - DNA, 412 bp, Ctenocephalides felis
  misc_feature (108)..(108): n = unknown
  misc_feature (134)..(134): n = unknown
  misc_feature (147)..(147): n = unknown
  misc_feature (158)..(158): n = unknown
  misc_feature (253)..(254): n = unknown
  misc_feature (342)..(342): n = unknown
  misc_feature (345)..(345): n = unknown
  misc_feature (395)..(395): n = unknown
  misc_feature (409)..(409): n = unknown
cgttatttatattatattgtttatacagaaagcactgttgtatgaaaagtatctgaaatcaacacatctcatgtaaggttactttattgtaaaagttattttatatgnaatttttaataacattaaaattattntgttctttctgtnagatgaattgngtgttagatcttgtgctgtgatttacatacaatttaatacagattgaaatgcaatctataaaagcattatttcaataatcattatatagtaattnngattttgactatttgcagataaattcattacattttaaaatgtttactttattaagctatacaaaccttgaactttacactttgtatntctagaacataagtattaaataaattgctaaaaatatttgtggctagattctnctattgctaattgngtg

SEQ ID NO: 498 - DNA, 386 bp, Ctenocephalides felis
atatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 499 - DNA, 118 bp, Ctenocephalides felis; identical to SEQ ID NO: 471

SEQ ID NO: 500 - DNA, 500 bp, Ctenocephalides felis
  misc_feature (100)..(100): n = unknown
  misc_feature (178)..(178): n = unknown
  misc_feature (243)..(243): n = unknown
  misc_feature (359)..(359): n = unknown
tttttttttttttttttttttttttttaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttgttgttaaccaagaaacattgataatattttttacaatctcttcgatcggaaaaaacgttttcacttttgcatgcagtctgccgagaaagattttgggtcaaaccattcgttgacgtcgcttcacat

SEQ ID NO: 501 - DNA, 498 bp, Ctenocephalides felis
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatatat

SEQ ID NO: 502 - DNA, 500 bp, Ctenocephalides felis
tttttttttttttttttttttttttaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggcaaaccattcgttgacgtcgcttcacatt

SEQ ID NO: 503 - DNA, 408 bp, Ctenocephalides felis
tgaaggcccttcgggcaggtaccctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattagattcgatgtaagatatatgt

SEQ ID NO: 504 - DNA, 500 bp, Ctenocephalides felis
  misc_feature (48)..(48): n = unknown
  misc_feature (176)..(176): n = unknown
tttttttttttttttttttttttttaatttcataaagcttctatattnatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgtcgcttcacat

SEQ ID NO: 505 - DNA, 498 bp, Ctenocephalides felis
gaggagactttgtttaccgtaatggacgaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatatat

SEQ ID NO: 506 - DNA, 173 bp, Ctenocephalides felis
cgaaacccgagcaaaaatgtaaaaaagtaaaatttagttgcgtgaattcgtgcagttcacccgaaatgcggtattgtccggaaataggagcagatccggttaaggaatcctgtagcccagatcaagtgtgcgctgatcaaagtggatatctacagtgcaccactaaagaaagt

SEQ ID NO: 507 - DNA, 498 bp, Ctenocephalides felis
  misc_feature (488)..(489): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgcataaaattgtattttatgtaaggagcacaaacaaaatgtcattaactatagtaatttctgattatttaaaatatataaatatagaagctttatgaaattaaaaaaannaaatgaaaa

SEQ ID NO: 508 - DNA, 498 bp, Ctenocephalides felis
  misc_feature (60)..(60): n = unknown
tttcgcagtttacaaatccagaagagataccagagcaacttcaacatcagatcaatgagngcagttcacaattaagaatgtctagttcagagctaacaaagctgctatcgtcattatcaagcatattgagcgatcaatcatatatccaacagcttctcgatatcaacgataccatcactgagatgtcagaagttgaaaattgaaagtcatcaacaaatgccatgtcatcaaagaatggcacgtcataaataattttattaaattctttttaaaatttatgtattattaaattgtaatgtctaatgcttcatattagtattaagttttcaaatttttatgtttttttttgtattgtattaatagtttacttatttttcttattttgatatacctggtaatttgtaacttataaagaagcttaagctcgtataaactatctttatattatcaatgcttatgtattttaaacaaaaataaaatgctttgaaaggaaaaaaa

SEQ ID NO: 509 - DNA, 414 bp, Ctenocephalides felis
  misc_feature (52)..(52): n = unknown
  misc_feature (54)..(54): n = unknown
  misc_feature (65)..(65): n = unknown
acacaattagcaataggaaaatctagccacaaatatttttaacaatttattngntacttatgtgnctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatataaataacggt

SEQ ID NO: 510 - DNA, 229 bp, Ctenocephalides felis
aacatttctgactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtaggtgatgataccttgaacagatactccaaaaccacggt

SEQ ID NO: 511 - DNA, 223 bp, Ctenocephalides felis; identical to SEQ ID NO: 450

SEQ ID NO: 512 - DNA, 414 bp, Ctenocephalides felis
  misc_feature (65)..(65): n = unknown
ccgttatttatattatattgtttatacagaaagcactgttgtatgaaaagtatctgaaatcaacncatctcatgtaaggttactttattgtaaaagttattttatatgtaatttttaataacattaaaattattttgttctttctgttagatgaattgtgtgttagatcttgtgctgtgatttacatacaatttaatacagattgaaatgcaatctataaaagcattatttcaataatcattatatagtaattttgattttgactatttgcagataaattcattacatattaaaatgtttactttattaagctatacaaaccttgaactttacactttgtatttctagaacataagtattaaataaattgttaaaaatatttgtggctagattttcctattgctaattgtgtgt

SEQ ID NO: 513 - DNA, 498 bp, Ctenocephalides felis
gatgaaatcaagaaattgttgtaaattaagcaataaacaaccataaaaaaaaaagagaaaaatctaaaaacaatttaaattagcaaaaccaagtgtatttgaatttcatttttgcacaagttacctttttgtattaaaatatatgtatatttatgaatatgtatttcttgtattttaggttaaattcgttatagaataatttggaaatacatattcataatgctaaagtattaaattggcttttttccattaaaatcctatttaacattatacatatattttattgtcaaatgtgaggcggtatggaatcacgggtggctgctttctgagtagtcgaaccttttaggcaaaaattgtgtagatcaaactcagttctacaatcttgagctcatccacattctcagaacatccatgtatttaagttaacttattgtatttaacagtttttgaggaaatctgtaaatatgtttaagataaatacaagtaaaattgtcgaat

SEQ ID NO: 514 - DNA, 267 bp, Ctenocephalides felis
cccgctgtcggaccaaagtcgcttcatagctgctaaaagttcctcggaaaatgcttctgtatcctccatacgttggattacgtcaaagaccattttgccgtccgtctctctttcattgttcccaaaactaatgcccaaattgggcatggcccgcagtatggcaaccagtgattgaatggtattactgtaaacaactggtcgatattgtttgaagtcttcgcttgtgaaacccgactcatggataattttcatttgttttacgatagt

SEQ ID NO: 515 - DNA, 131 bp, Ctenocephalides felis
cttttgcatgtaggatccaatggatcgcgaaatagtccaactcttggacaaatgaatggttgctgccaaatacgaacgctgctggaatttgtttcaactggaattagttcttgagactccaaagacaatgt

SEQ ID NO: 516 - DNA, 156 bp, Ctenocephalides felis
ttttatttgtcaaaaagctacataagctagaaccattagaccacaaataatatatcactagacatttttaggaagtttacagtttgttatacaattcttaaactaatttagttatcagtaagttttaagcagtcggcacagtctttacggacttgt

SEQ ID NO: 517 - DNA, 245 bp, Ctenocephalides felis
gggtggatcattccaacctggtggtggtgtagggtttgctctacttggcatttgagtaggaggtggtgcttgcggttggaattgattgacaaaacctgctccttgtggtgaattcaacatagggttaagtagggcatttgttggttgaggttgagaactaataggattcagaagacttgctggttgttggaattgaccagacattgtgctcatcgtaactgtattggcatttacaggcgaattgt

SEQ ID NO: 518 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatgcccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgtatctttttaata

SEQ ID NO: 519 - DNA, 413 bp, Ctenocephalides felis
  misc_feature (64)..(64): n = unknown
acacaattagcaataggaaaatctagccacaaatatttttaacaatttatttaatacttatggnctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatataaataacggt

SEQ ID NO: 520 - DNA, 95 bp, Ctenocephalides felis; identical to SEQ ID NO: 438

SEQ ID NO: 521 - DNA, 143 bp, Ctenocephalides felis
taattaattttaaaaaattaaggatagaaaccaacctggcttaaaccggtttgaactcagatcatgtaagaattaatggtcgaacagaccaaattttaaaacttctgcattttaaaattatcttaatccaacatcgaggtcgc

SEQ ID NO: 522 - DNA, 500 bp, Ctenocephalides felis
  misc_feature (48)..(48): n = unknown
  misc_feature (109)..(109): n = unknown
  misc_feature (140)..(140): n = unknown
  misc_feature (216)..(216): n = unknown
  misc_feature (255)..(255): n = unknown
  misc_feature (373)..(373): n = unknown
  misc_feature (414)..(414): n = unknown
  misc_feature (433)..(434): n = unknown
  misc_feature (444)..(444): n = unknown
tttttttttttttttttttttttttttagcggcccaaacgatttattnttattaaaaagatacatgtaatttcataaagcttctatatttatatattttaaataatcanaaattactatagttaatgacattttgtttgngctccttacataaaatacaattttatacattttaatttttatacatattttttatatttaattgcacagatcattngggtatttattatattaattgactactttatgataattngaatcctaattagtctattcaagattgttttcctggtttaagccttacttagcaatctcacttttgcattcttcgccgggtggcgtgggtatgcatcgcaactccgttttatcaaagngcaagccatttggacaatcataatggtaatttgccatttgntggaaccaagaaacattgnnaatatttttntacaactcttcgatcggaaaaaacgtttcacttttgcatgcagttttgcaccgaga

SEQ ID NO: 523 - DNA, 118 bp, Ctenocephalides felis; identical to SEQ ID NO: 471

SEQ ID NO: 524 - DNA, 305 bp, Ctenocephalides felis
cattgtggatgaggcaaatcccatataccatgatgaagtttgcttgtttcgaaagaacagttgaattgttatacactcatgtggttcccaaacccagagcagaatgcactaaaggtgaacaattggttgtcacctttgctgctggttacattgccggtgtattctgtgcagtagtttctcatcctgcagacacagttgtttccaagctaaatcaagacaaaggagcaacagccattgacgctgccaaaaaacttggctttgctggtttatggaagggattaggacctaggatcatcatgattggt

SEQ ID NO: 525 - DNA, 304 bp, Ctenocephalides felis
ctgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaat

SEQ ID NO: 526 - DNA, 386 bp, Ctenocephalides felis; identical to SEQ ID NO: 468

SEQ ID NO: 527 - DNA, 488 bp, Ctenocephalides felis
  misc_feature (144)..(144): n = unknown
  misc_feature (249)..(249): n = unknown
aaacgatttatttttattaaaaagatacatgtaatttcataaagcttctatatttatatatttggaaataatcagaaattactatagttaatgacattttgtttgtgctccttacataaaatacaattttatacattttaattnttatacatattttttatatttaattgcacagatcatttgtgtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatatttttacaatctcttcgatcggaaaaaacgtttcacttttgcatgcagttctgcacgagaaagattttgggtcaaaccattc

SEQ ID NO: 528 - DNA, 386 bp, Ctenocephalides felis; identical to SEQ ID NO: 498

SEQ ID NO: 529 - DNA, 498 bp, Ctenocephalides felis
aataaatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagtacagcgtacggatatctggcgtcatatgtggttcccaagtatacaatgtatgggcctaatactcctaatgcatttgaaactatagttccaatggaaattcctgtctgcctcaaacaggttggatatgttttcattgcttgcagattcacaacataaaacgtgatgcttatgcaaaatttcattaccacggctaacagtgggaccaaattctggagggattcatcattggcaatgcatataagaatgg

SEQ ID NO: 530 - DNA, 451 bp, Ctenocephalides felis
  misc_feature (124)..(124): n = unknown
  misc_feature (149)..(149): n = unknown
  misc_feature (198)..(198): n = unknown
  misc_feature (229)..(229): n = unknown
ttttttttttttttttttttttttttccgacaattttacttgtatttatcttaaacatatttacagtatttcctcaaaaactgttaaatacaataagttaacttaaatacatggatgttctganaatgtggatgagctcaagattgtanaactgagtttgatctacacaatttttgcctaaaaggttcgactactcanaaagcagccacccgtgattccataccgcctnacatttgacaataaaatatatgtataatgttaaataggattttaatggaaaaaagccaatttaatactttagcattatgaatatgtatttccaaattattctataacgaatttaacctaaaatacaagaaatacatattcataaatatacatatattttaatacaaaaaggtaacttgtgcaaaaatgaaattcaaatacacttggttttgctaatttaaat

SEQ ID NO: 531 - DNA, 204 bp, Ctenocephalides felis
ggacggccgactcgtccgaattatgctcggcacgtgttcgattcaaatgatcccgctacgttcgacatccaaatgataaacactatctaatcaagtgatgttgtttaattaagcaagtgttagttcgaattcatttttgtgttttgtgtatattataataaatggaccccgaaattcctctgaaaggtgtgactccgggtttgt

SEQ ID NO: 532 - DNA, 500 bp, Ctenocephalides felis
  misc_feature (100)..(100): n = unknown
  misc_feature (178)..(178): n = unknown
  misc_feature (243)..(243): n = unknown
  misc_feature (359)..(359): n = unknown
  misc_feature (448)..(448): n = unknown
tttttttttttttttttttttttttttaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttgttgttaaccaagaaacattgataatattttttacaatctcttcgatcggaaaaaacgtttcacttttgcatgcngttctgcacgagaaagattttgggtcaaaccattcgtggacgtcgcttcaca

SEQ ID NO: 533 - DNA, 204 bp, Ctenocephalides felis
aaacccggagtcacacctttcagaggaatttcggggtccatttattataatatacacaaaacacaaaaatgaattcgaactaacacttgcttaattaaacaacatcacttgattagatagtgtttatcatttggatgtcgaacgtagcgggatcatttgaatcgaacacgtgccgagcataattcggacgagtcggccgtccgt

SEQ ID NO: 534 - DNA, 288 bp, Ctenocephalides felis
  misc_feature (66)..(66): n = unknown
  misc_feature (152)..(152): n = unknown
  misc_feature (266)..(266): n = unknown
ttttttttttttttttttttttttttttctttcatttattactataaatatcaatgagtcttaatntaccattacagtattaagtacattttcataatactacgaaaccaatagttcattatgtataactctcttatatatgaatttctganaaagtttatatgccagcttcttataataattacaaaatatatttttcagccaattccatcaatctgtcggtcatgatttctcgaaaatgttcatcgttattccaggctttgtanagaatggcttctctgtctccca

SEQ ID NO: 535 - DNA, 173 bp, Ctenocephalides felis
tttctttagtggtgcactgtagatatccactttgatcagcgcgcacttgatctgggctacaggattccttaaccggatctgctcctatttccggacaatactgcatttcgggtgaactgcacgaattcacgcaactaaattttacttttttacatttttgctcgggtttcggt

SEQ ID NO: 536 - DNA, 143 bp, Ctenocephalides felis
  misc_feature (5)..(5): n = unknown
  misc_feature (40)..(40): n = unknown
taatnaattttaaaaaattaaggatagaaaccaacctggnttaaaccggtttgaactcagatcatgtaagaattaatggtcgaacagaccaaattttaaaacttctgcattttaaaattatcttaatccaacatcgaggacgc

SEQ ID NO: 537 - DNA, 462 bp, Ctenocephalides felis
  misc_feature (62)..(62): n = unknown
  misc_feature (455)..(455): n = unknown
ataaaaccaattcggtaaggtgcaataactttatcatttgaatgcccatcgtgatgctgggngttccatacagaattcacagtcgtatttttaccctcaggacaaccttcagtcgacatatttaggtaaggaaacttcaaattaccttgagcaatgttaatttgggctccacttaccatccaactgaccaggattagacttgctgcagctcccaccaaaactccctttgtgtttgctttagggaacaagattcccaatgtaaacattcccaaaagggttcctgcagtaactccagtgacactaatgaccaaatgcatgacgcttcctaattgttctactacaaagacaagtccgaggcaaattcctccaattactactacagtcagcttcataatattactggcagtcttctcactagtggtaactgggtaaccattccttaataaaatcttcgntaaagtg

SEQ ID NO: 538 - DNA, 498 bp, Ctenocephalides felis
aataaatcatggtctgaagagacaaataagattgaaagtcaaataataccttgtcagcatggttatgaatatgacagaacatggtatttatcaacggctccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgtcaccggaagactaattacagcatttacttccagttggtttattgtttttataacagcggcttttcttggttcactaacatctacatctgtttttcaaagcccttcgataattgcgatggaaatatccagaagtgaagatagagcacacattgccatgatgcagtccatcgggtggaccagtggaatgattcttatgccgttactgatgtgggcgacgcgagattggtttatctttgctttg

SEQ ID NO: 539 - DNA, 172 bp, Ctenocephalides felis
cgaaacccgacaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagt

SEQ ID NO: 540 - DNA, 352 bp, Ctenocephalides felis
gacaatctaataagggccacatcatgttcgaaagatgtaaagttggtgtcaaagtcgggatgtaataaataaaaattggcatccacaattataccagcgtaataagccctaaagctgccaactcgaacttgaacttgtttttcgttgcggacatttttgaagcattgagcaacagtgagcacaaaatatctactaactatgactcctccacaaatatgatcacctctatataaaacagatgccacgtaaggtaattcgctgatgtcagcaggctttcctccgatcatacgagaatcggtcaaatttttgctttctgctccagaaaataatacaataaagaaaattgcaaagt

SEQ ID NO: 541 - DNA, 498 bp, Ctenocephalides felis
aataaatcatggtctgaagagacaaataagattgaaagtcaaataataccttgtcagcatggttatgaatatgacagaacatggtatttatcaacggctccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgtcaccggaagactaattacagcatttacttccagttggtttattgtttttataacagcggcttttcttggttcactaacatctacatctgtttttcaaagccctttgataattgcgatggaaatatccagaagtgaagatagagcacacattgccatgatgcagtccatcgggtggaccagtggaatgattcttatgccgttctgatgtgggcgacgcgagattggtttatctttgctttgg

SEQ ID NO: 542 - DNA, 500 bp, Ctenocephalides felis
  misc_feature (67)..(67): n = unknown
tttttttttttttttttttttaattgcaatgtattaaatattcaaatataaagttacatatggaaanctaaaaaatgtaatcaaacgtattgcaattatatacattattattaaatgtaacactttatttaaatataaatcattaaaatattaaaaatatattttatacatctcatagaatagtgccaagcatttacaatctctcaaatcacaccttcaccttttttctaaattataaaacaaccaaagaaaaactaagattctgtcaagcatgagaaaatcttaatgtaacacactaactcgaaaccttttaagattattaatctgtgactctaaataattgcagtaattttggaatgaatttttatagataattggaaagagatcaaagggaaagtttattgcaataacaacaatgaattataacttgagacttgttaaaaagacctgtatctacttgccggggctgttgaaatatgagccacaggtttctggcattg

SEQ ID NO: 543 - DNA, 173 bp, Ctenocephalides felis
tttctttagtggtgcactgtagatatccactttgatcagcgcacacttgatctgggctacaggattctttaaccggatctgctcctatttccggacaatactgcatttcgggtgaactgcacgaattcacgcaactaaattttacttttttacatttttgctcgggtttcggt

SEQ ID NO: 544 - DNA, 491 bp, Ctenocephalides felis; identical to SEQ ID NO: 459

SEQ ID NO: 545 - DNA, 500 bp, Ctenocephalides felis
ttttttttttttttagtttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgtcgtcttcacatttcagacgat

SEQ ID NO: 546 - DNA, 386 bp, Ctenocephalides felis
atatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcggcccatcattaaagatatacatactgccattgccctgagttgtgtagggt

SEQ ID NO: 547 - DNA, 500 bp, Ctenocephalides felis
  misc_feature (67)..(67): n = unknown
  misc_feature (177)..(177): n = unknown
  misc_feature (242)..(242): n = unknown
  misc_feature (358)..(358): n = unknown
  misc_feature (470)..(470): n = unknown
  misc_feature (494)..(494): n = unknown
tttttttttttttttttttttttttttatttcataaagcttctatatttatatattttaaataatcngaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttgttgttaaccaagaaacattgataatattttttacaatctcttcgatcggaaaaaacgttttcacttttgcatgcagttctgcacgagaaagattttnggtcaaaccattcgttgacgtcgncttcac

SEQ ID NO: 548 - DNA, 220 bp, Ctenocephalides felis; identical to SEQ ID NO: 494

SEQ ID NO: 549 - DNA, 223 bp, Ctenocephalides felis
cacggccgaggggttcagagttgtcagtcttaactgtgaaggaacctcctgcggaagattcccaaaggtattgttcatcatcattgtgcttagatgtgaccgtgactttatcagcaacgagataggccgagtagaaaccaacaccaaattgaccaatcatactaatatcggctccagcttgtaaggcttccatgaaggctttagttccagacttcgcaattgt

SEQ ID NO: 550 - DNA, 336 bp, Ctenocephalides felis
aattcggctttcgagcggccgcccgggcaggactgataaattgcctgcaagaatgagtttcagggaacgaaaagaatcggccaaatgcatgcaaaaggttgcattaaatatacaactagcagcagccagagtttcaactgatgttggcattaaagtaggggaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaat

SEQ ID NO: 551 - DNA, 131 bp, Ctenocephalides felis; identical to SEQ ID NO: 515

SEQ ID NO: 552 - DNA, 500 bp, Ctenocephalides felis
  misc_feature (133)..(133): n = unknown
  misc_feature (207)..(207): n = unknown
  misc_feature (332)..(332): n = unknown
  misc_feature (387)..(387): n = unknown
  misc_feature (406)..(406): n = unknown
  misc_feature (463)..(463): n = unknown
ttttttttttttaaataaagcatttattgggttttttacaagcataaataaaatttcttaacttaatagcgcaagaagcatattgtataaaaaaagcttttgtataaagttcttatttttattttcatattgngccctaataagatttatacttaaaacaataaaaaatgcgttttattaaaagttgcaagcagttaaataaaatgntgaataaataatagtgataaatcattgcataatgatgcaactcataattattaagtaaattggctataacaactactacattatcagatctatccgcacttcttaatattcaataatattatggntatcaggcctcttatcactttatagatttttaattaatctatttaatattaaatnaaaaattaatttaaaaccnttaaaccgatcattgctttaaatggaataaatcccatacccttattaagcctggtgnaatatgccatagccatttcatataccactccttagga

SEQ ID NO: 553 - DNA, 540 bp, Ctenocephalides felis
  misc_feature (273)..(273): n = unknown
  misc_feature (389)..(389): n = unknown
  misc_feature (405)..(405): n = unknown
  misc_feature (408)..(408): n = unknown
  misc_feature (525)..(525): n = unknown
ttttttttttttttttttttggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttgntgntaaccaagaaacattgataatattttttacaatctcttcgatcggaaaaaacgttttcacttttgcatgcagttctgcacgagaaagattttgggtcaaaccattcgttgacgtcgncttcacatttcaagt

SEQ ID NO: 554 - DNA, 387 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaaaaaaaaaaaaaaaaaaaaaaaaaaaaa

SEQ ID NO: 555 - DNA, 510 bp, Ctenocephalides felis
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatatatgaaaaaaaaaaa

SEQ ID NO: 556 - DNA, 345 bp, Ctenocephalides felis
  misc_feature (55)..(55): n = unknown
  misc_feature (61)..(61): n = unknown
  misc_feature (86)..(86): n = unknown
  misc_feature (152)..(152): n = unknown
  misc_feature (164)..(164): n = unknown
  misc_feature (184)..(184): n = unknown
  misc_feature (231)..(231): n = unknown
  misc_feature (292)..(292): n = unknown
  misc_feature (296)..(296): n = unknown
  misc_feature (300)..(300): n = unknown
  misc_feature (308)..(308): n = unknown
tttttttttttttaatttcataaagcttctatatttatatattttaaataatcanaaattnctatagttaatgacattttgtttgngctccttacataaaatacaattttatacattttaatttttatacatattttttatatttaattgcncagatcatttgngtatttattatattaattgnctactttatgataatttgaatcctaattagtctattcaagattgttntcctggtttaagccttacttagcaatctcacttttgcattcttcgccgggtggcgtgggtntgcntcgnaactccgntttatcaaagtgcaagccatttggacaatcataatgt

SEQ ID NO: 557 - DNA, 262 bp, Ctenocephalides felis
  misc_feature (171)..(171): n = unknown
  misc_feature (248)..(248): n = unknown
ttttttttttttttttttttttttttttatttttaaaaaatatttattatacaacaagaattacaattatataaatgtttccgctatggagaatatcagtttatcatatttataattataaaatattcaataataatgaactatttaacaaatgaaccattttagtattgnaaaaatatgaaactctcttctaaaccttacgaataaatgcttttcaatgaacaagccgaattgaaatgcacatttgnggaatataaatagt

SEQ ID NO: 558 - DNA, 578 bp, Ctenocephalides felis
  misc_feature (160)..(160): n = unknown
  misc_feature (238)..(238): n = unknown
  misc_feature (303)..(303): n = unknown
  misc_feature (372)..(372): n = unknown
  misc_feature (419)..(419): n = unknown
tttttttttttttttttttttttttttgtaataattaattacaaaggaacggcccaaacgatttatttttattaaaaagatacatgtaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattgntttcctggtttaagccttacttagcaatctcacttttgcattcttcgccgggtggcgtgggtatgcatngcaactccgttttatcaaagtgcaagccatttggacaatcataatgntttatttgccatttgttgttaaccaagaaacattgataatattttttacaatctcttcgatcggaaaaaacgttttcacttttgcatgcagttctgcacgagaaagattttgggtcaaaccattcgttgacgtcggcttcacatttcagtccttgggcg

SEQ ID NO: 559 - DNA, 671 bp, Ctenocephalides felis
  misc_feature (177)..(177): n = unknown
  misc_feature (416)..(416): n = unknown
  misc_feature (518)..(518): n = unknown
  misc_feature (536)..(536): n = unknown
  misc_feature (563)..(563): n = unknown
  misc_feature (567)..(567): n = unknown
ttttttttttttttttttttttttttttagactatagttctatttattctttagcattttttgatgttacatttttacaataataccaagtaaaataatgacttcattcatataataaagggtttaatacgccgatttaaaaacagacatcttatacaaaattaaaatggctgctgntaaattatagaatatcttttgatttaaacaaaatctaaatagtacataaaactggacattacttccattatatatatagatatatacatatgtatgttaatgtatatatacataaatacatatagaatcaaacaatatcacaaactgttgatttgaataagttgctattcataaaattatgttttcgcatttagtacattttttgtatgtgcttaagatgtatataaacacatatttgntaattagtaaaaattaacataagcttgagacattattaggtgctactaaaattgataaatatttacataaattaaaacaatttcaattcttatatgtgtggnagtaacttcaaaatctgnggaaatattggttaaattggtactggnctgnaaataatttactaaacagaaattatattgactcctatctggcattggcttcttaaccattttaaatttaatttacttaatctcttcagaaatagcttaataagg

SEQ ID NO: 560 - DNA, 491 bp, Ctenocephalides felis; identical to SEQ ID NO: 459

SEQ ID NO: 561 - DNA, 431 bp, Ctenocephalides felis
  misc_feature (15)..(17): n = unknown
  misc_feature (19)..(20): n = unknown
  misc_feature (22)..(23): n = unknown
  misc_feature (34)..(34): n = unknown
  misc_feature (61)..(61): n = unknown
  misc_feature (264)..(264): n = unknown
  misc_feature (272)..(272): n = unknown
  misc_feature (339)..(339): n = unknown
  misc_feature (355)..(355): n = unknown
ttttttttttttttnnntnntnnttttttttagntattaattaataacgaagtcatcattnatgaaataattaatgaacgactttaggataattatttatatacatttttataagaaaagactcattattttataagtatttaaatttcaaaatcaagtttttgggatggagcagaagaataaatatatttattatatcgcccgactgttatacgatgagattttcttatgaaagtggttccctggtcgtgttaggcaaaaatngacacatnagaccaccttcagccaatagtagtgctcaataaatgtcggggctggacaatacatgtctaataaagntgcaattccacattgncaattatgccttcaagtcgagcaggtccatagatattggcacaccagtagccctcaaatttggtggaaacccttgg

SEQ ID NO: 562 - DNA, 348 bp, Ctenocephalides felis
  misc_feature (144)..(144): n = unknown
  misc_feature (194)..(194): n = unknown
  misc_feature (240)..(240): n = unknown
tttttttttttttttttttttttttttcattatatttctaatctaatatccccaaatttcaactaagaagttaaatcctttgccagtctgagaagataggagtaaagttacatttttccagccaactccaccattgacaagagnggcatagcctccttggccatttacatattggtccagggcacgaacacagntaattgtgcgattatttctcgatcccactggtggaaatgacacctntctagtaactttcctgaaaaagcttccacttttggattggacttgacggtacagcaacacgtttccataacttgggtatcctacttgaaagtgatgactattgttagt

SEQ ID NO: 563 - DNA, 584 bp, Ctenocephalides felis
  misc_feature (161)..(161): n = unknown
  misc_feature (197)..(197): n = unknown
  misc_feature (262)..(262): n = unknown
  misc_feature (462)..(462): n = unknown
  misc_feature (515)..(515): n = unknown
ttttttttttttttttttttttttttttacgtatttatttattctctttataattttgaacattgacggcattaacattttttacctatgagtatgtacatatatcttacatcgaatctaataacaataaagagttattaattttcatgtcgatgttttanaaaatgattcagtagcaacttctgaattttctttgnaattgataatactttctcaaagtataattgcatttcacaacacacgacggaaatatggttatggnccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgncattgccctgagttgtgtagggtcagatctactaatgccgcgtttaccactgncacagcaattccgcaaaccagcaaccacaaatataaatatgatgctattggtaaatggtcaataaatgc

SEQ ID NO: 564 - DNA, 491 bp, Ctenocephalides felis; identical to SEQ ID NO: 459

SEQ ID NO: 565 - DNA, 173 bp, Ctenocephalides felis; identical to SEQ ID NO: 361

SEQ ID NO: 566 - DNA, 665 bp, Ctenocephalides felis
  misc_feature (413)..(413): n = unknown
  misc_feature (582)..(582): n = unknown
taagttgtccctaaattctttcaaggctccccttgcgcattttccgacttcacggactaagttgcccaattgggaccaggtttctttgagtgccttggccaagtcttttgctccttcgtgggcagcttggagaacccctttcaagcaaactctggcttcatcgacatcggctgcggtcacaacgcactccttggcttgtgctctgagggcttcggcgttctccctggcttctctccaggcggccaagccattttggcgaacttggttgaattcatcacgtttgtcatctctgcaagccttgaccttagcacgggcttcttgtgcgtagcctagagctttttggtgttggcctttaaggcattcctttgcggcttcactcacttttttgctaagtttcctttcaacttctttgntgaacctctccaaatctctatcgacttcaggggcaaatccttggttttcgaattcagcggcaatcatatcaattttgctatcttggctaattcttgcaatgctggtctcatattcagcagagatgtcatctaccatcttatctaagacggcatcttggtcgaaaaaagncttgtgcaagccctataaaagccaatgatggcaagagcaacaaacactttggacaccattttgaaaatgattaattcacaata

SEQ ID NO: 567 - DNA, 476 bp, Ctenocephalides felis
taaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgtcgtcttcacatttcaagt

SEQ ID NO: 568 - DNA, 172 bp, Ctenocephalides felis; identical to SEQ ID NO: 539

SEQ ID NO: 569 - DNA, 466 bp, Ctenocephalides felis
aagcaagttttcttgggtggagttgacaagaagacccaattctggcgttacttcgcaggaaacttggcatctggtggtgctgctggagccacatcattgtgcttcgtctacccacttgatttcgcccgtaccagattggccgctgatgtaggtaaaggcgctggtcaacgtgaattctctggattgggcaactgcttgaccaaaatcttcaagtctgatggtctccctggattgtaccgtggttttggagtatctgttcaaggtatcatcatctaccgtgcagcatactttggattctatgacaccgctcgtggaatgttgccagaccccaagaacaccccattagttatcagctgggccattgcacaagccgtcgcaactgttgctggtattgtgtcatatccattcggcactgtccgtaggcgtatgatgatgcagtctggacgtgcaaagtcagaaatgttgt

SEQ ID NO: 570 - DNA, 221 bp, Ctenocephalides felis; identical to SEQ ID NO: 436

SEQ ID NO: 571 - DNA, 365 bp, Ctenocephalides felis
tttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaacattctaataaatatgttacccagc

SEQ ID NO: 572 - DNA, 112 bp, Ctenocephalides felis
  misc_feature (58)..(58): n = unknown
ctggtttgcaagtcattccactcggacatgtttccaatgttgtttctaagaaatcagngccaatcgcaatgcaaaggtttgctgtctcacaatcctggcactttatttctcc

SEQ ID NO: 573 - DNA, 210 bp, Ctenocephalides felis; identical to SEQ ID NO: 416

SEQ ID NO: 574 - DNA, 269 bp, Ctenocephalides felis
  misc_feature (59)..(59): n = unknown
  misc_feature (66)..(66): n = unknown
  misc_feature (87)..(87): n = unknown
  misc_feature (117)..(117): n = unknown
agatctactaatgccgcgtttaccactgtcacagcaattccgcaaaccagcaaccacanatataantatgatgctattgttaaatgntcaataaatgcacaaattattccacaaatnccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 575 - DNA, 425 bp, Ctenocephalides felis
gatcggttgcaatttgtcattgcaccaagcataaattgatgggtccggtgcataggtgtataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaaacaatcgtgacaaaatgttcccaactgcttattagt

SEQ ID NO: 576 - DNA, 422 bp, Ctenocephalides felis
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgtgcatgtagtttctgccgtcttacagttttccccaggttttgatgagcacatatcatctacacaaaatggagcatcggaatttgagtctctgcaattgattgttgtaattggggtttcttgccagcgcacaacttcaaagtagaacaatcgtgacaaaatgttcccaactgcttattagt

SEQ ID NO: 577 - DNA, 418 bp, Ctenocephalides felis
  misc_feature (15)..(15): n = unknown
  misc_feature (56)..(56): n = unknown
  misc_feature (58)..(58): n = unknown
  misc_feature (65)..(65): n = unknown
  misc_feature (93)..(93): n = unknown
  misc_feature (130)..(130): n = unknown
  misc_feature (187)..(187): n = unknown
  misc_feature (200)..(200): n = unknown
  misc_feature (213)..(213): n = unknown
  misc_feature (354)..(354): n = unknown
  misc_feature (363)..(363): n = unknown
  misc_feature (365)..(365): n = unknown
  misc_feature (392)..(392): n = unknown
aagcttttttttgtntttacttttttttttttttttattattgaaattcatttatngnctataangaaaatttcacatatttatattcataantttactacatttctaagccttcattataatacccggngcctgcagctccactagttttacttgcattagaattaatattgtttggataatcgtnatttttaatactnggatttgtattanttaaatttttggcccatggctgcactttgccggatgcaaaaaaccaatatatcacagctcctaacaaatatattccacttgaaatgtaaaatacaatttgccacgatgtgagtaaatcatctccaacctttccattaacantgaaaccantnaattgagggctgattattcctggcaangttgcaaaagtatttgacaatcccat

SEQ ID NO: 578 - DNA, 423 bp, Ctenocephalides felis
  misc_feature (251)..(251): n = unknown
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtantttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 579 - DNA, 308 bp, Ctenocephalides felis
  misc_feature (58)..(58): n = unknown
atatctagccaatattgcaaaattcttatcagtgcatgtgaaagaaaaactattattntcgaaaatatatcaatattattataagtaaagaaattgtcattccgaatgaacttctgaggtctaaagacccattacacaagtcagtgtcgcacatggtgcaatttagatcccgggctcctttatttgttaaatctttctttatttcttcacatgtgactcgggcagggacacattctctaatcacacctttttcaatcatggatttatagaaaactctttctccgatgtctgttgtacactagcgatta

SEQ ID NO: 580 - DNA, 429 bp, Ctenocephalides felis
  misc_feature (298)..(298): n = unknown
  misc_feature (374)..(374): n = unknown
acccggtatgaaaaggaaagtgcttttacgtccaaaccgtggagtttccaatatgccacatgtcattattcgtttactattcttatccttaatatttatagcactgtcgtaataattctttgtaaaatgagccatatctctgttgagagtcataccgtaatcatatcgacattgatatgattctccacataaatcttcagcacgattgatgtcgctacttctgtttgatggaagaaaatctttaggttctttaacccagtttggtataaatgaggaatttgcataataactggctgtncgaccaaattcacgagtgaagagtgccgctccgaggtgttcattttcacgatccgcagcatccagtgacgtgcganatctttatgaacagattcaaaactattgagattaacaggcacaaaagttccatca

SEQ ID NO: 581 - DNA, 498 bp, Ctenocephalides felis
atgacttacctgaaaacacgacctccaagtatggaagtaaatgctattgatatgattatagacctcacaaaaaaatataaagttaggtctcacatagtgcatctatcagcagcaggtgctttaccgcaattgaaaaaagcgcgctcagagaacgttccactttcgattgaaacttgtcatcattacttaacctttgctgctgaagatgttccagatggacatactgaatacaaatgcgctccaccaattagagaagaaagtaatcaagaaaaattatggcaagctttggaaaacggagatattgatatggtagtcagtgatcattctccatcacctgctgcactgaaaggcctgtgcaatggttgcatcctgatttcctaaaagcttggggtggaattgctggtatgcagtttggattatctttattatggaccggtgcttctaaaagagctttaaagctcatgatgtatctcgtttattatctgcgggacctgcgaa

SEQ ID NO: 582 - DNA, 486 bp, Ctenocephalides felis
  misc_feature (391)..(391): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgnattttatgtaagggagcacaaaccaaatgtcattaactatagtaatttctgattatttaaaatatataaatatagaagctttataaaaaaaaaaa

SEQ ID NO: 583 - DNA, 393 bp, Ctenocephalides felis
  misc_feature (350)..(350): n = unknown
  misc_feature (370)..(370): n = unknown
  misc_feature (391)..(391): n = unknown
ccgtcgtgtgctggaattcggcttcgagcggccgcccgggcaggacgatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagcctttcggatctggctgatatcctacaaccgcgcatgtagtttctgccgtcttacagttttccccaggttttgatgagcacatatcatctacncaaaatggagcatcggaatntgagtctctgcaattgattgntg

SEQ ID NO: 584 - DNA, 325 bp, Ctenocephalides felis
actgtagtctcgtgaaatttgtttattaaaatccgaaagtaatggataattcaaaccacctaagccgcctacttttctatccatgttaatccatgctaagtggctaaaatgtgaatccgttgagcatccaacaacctcagcaccgatttcccgaaactggcctattgcatcactataagcacgaatctccgttggacagacaaaagtaaaatctaaggggtagaagaacaataccaaatatttgcctttataatctgttaagctgatcttcttaaaatcaccattgacaactgccataccttcaaaatgaggggctggactttgt

SEQ ID NO: 585 - skipped

SEQ ID NO: 586 - DNA, 423 bp, Ctenocephalides felis
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacctcaaagtagaacaatcgtgacaaaatgttcccaactgcttattagt

SEQ ID NO: 587 - skipped

SEQ ID NO: 588 - DNA, 422 bp, Ctenocephalides felis
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgccagcgcacaacttcaaagtagaacaatcgtgacaaaatgttcccaactgcttattagt

SEQ ID NO: 589 - DNA, 498 bp, Ctenocephalides felis
  misc_feature (443)..(443): n = unknown
aacagttgcatgaactttgcccttcaacgtcattcctaagtatggtgtttctttattcttgtgttggattatgtctttagtgaccttaaattcttcctcaggatcccaaattactaaatcagcatccaagccttctttgatttgtccttttatgccatccagtccagttaatttcgcaggtcccgcagataataaacgagatacatcatgagctttaaagcctcttttagaagcaccggtccataataaagataatccaaactgcataccagcaattccaccccaagcttttaggaaatcaggatgacaaccattgcacaggcctttcagtgcagcaggtgatggagaatgatcactgactaccatatcaatatctctgttttccaaagcttgccataattttttttgattactttcttctctaattggtggagcgcatttgnattcagtatgccatctggaacatcttcagcagcaaaggttaagtaatgatgacaa

SEQ ID NO: 590 - DNA, 463 bp, Ctenocephalides felis
  misc_feature (383)..(383): n = unknown
  misc_feature (433)..(434): n = unknown
  misc_feature (443)..(443): n = unknown
  misc_feature (445)..(445): n = unknown
gaggagactttgtttaccgtaatggacaaccattcgaaattccaaaaggaaatttactattgaatgattaaatgtaatagattaatcaaattttagattattaaaattggtctattactacagtagcaacctcagcctgaaaattaaccgaacaaatttctaacccttatcaatgtatagattttgaaaaataacatagaaatactatttttttgatgactgtaataaaaaaatgtataaatggccatacctgaaaagatttctatgtgtattttttattaccttttattgctgaatggataaaagataactacaatttcataagctcttggattaaattaattttgaataaatccataattataaaatatgttaagtagcanattgaaatatggaactacaaaatgtatacgaaatataacttatataatannaaatggacncnccctgaaaaaaaagcttg

SEQ ID NO: 591 - DNA, 500 bp, Ctenocephalides felis
  misc_feature (67)..(67): n = unknown
  misc_feature (75)..(75): n = unknown
  misc_feature (124)..(124): n = unknown
  misc_feature (142)..(142): n = unknown
  misc_feature (149)..(149): n = unknown
  misc_feature (198)..(198): n = unknown
  misc_feature (257)..(257): n = unknown
  misc_feature (378)..(378): n = unknown
  misc_feature (398)..(398): n = unknown
  misc_feature (460)..(460): n = unknown
  misc_feature (485)..(485): n = unknown
tttttttttttttttttttttttttttcgacaattttacttgtatttatcttaaacatatttacagnatttcttnaaaaactgtcaaatacaataagttaacttaaatacatggatgttctganaatgtggatgagctcaanattgtanaactgagtttgatctacacaatttttgcctaaaaggttcgactactcanaaagcagccacccgtgattccataccgcctcgcatttgagaataaaatatatgtataangttaaataggattttaatggaaaaaagccaatttaatactttaacattatgaatatgcatttccaaattattctataacgaatttaacctaaaatacaagaaatacatattcataaatatncatatattttaatacaaaanggtaacttgtgcaaaaatgaaattcaaatacacttggttttgctaatttaaattggttttanattttctctttttttggtatggtgnttattgcttaattta

SEQ ID NO: 592 - DNA, 173 bp, Ctenocephalides felis; identical to SEQ ID NO: 395

SEQ ID NO: 593 - DNA, 500 bp, Ctenocephalides felis
  misc_feature (72)..(72): n = unknown
  misc_feature (143)..(143): n = unknown
  misc_feature (145)..(145): n = unknown
  misc_feature (183)..(183): n = unknown
  misc_feature (221)..(221): n = unknown
  misc_feature (223)..(223): n = unknown
  misc_feature (229)..(229): n = unknown
  misc_feature (241)..(241): n = unknown
  misc_feature (359)..(359): n = unknown
  misc_feature (378)..(378): n = unknown
  misc_feature (406)..(406): n = unknown
  misc_feature (421)..(421): n = unknown
  misc_feature (423)..(423): n = unknown
tttttttttttttttttttttttttttttctgaacggcccaaacgatttatttttattaaaaagatacatgnaatttcataaagcttctatatttatatattttaaataatcagaaattactatagttaatgacattttgttngngctccttacataaaatacaattttatacattttaattnttatacatattttttatatttaattgcacagatcattngngtattnattatattaatngactactttatgataatttgaatcctaattagtctattcaagattgttttcctggtttaagccttacttagcaatctcacttttgcattcttcgccgggtggcgtgggtatgcatcgnaactccgttttatcaaagngcaagccatttggacaatcataatgtgntatttgccatttgtngntaaccaagaaacattgataatattttttacaatctcttcgatcggaaaaaacgttttccttttgcatgcagttctgc

SEQ ID NO: 594 - DNA, 500 bp, Ctenocephalides felis
tttttttttttttttttttttttttgcaaaggaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcactttgcatgcagttctgc

SEQ ID NO: 595 - DNA, 498 bp, Ctenocephalides felis
  misc_feature (349)..(349): n = unknown
ctagtgagtgtgttatatgaaattgctattgcatattacatacaagcttaataaaggttatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgntttaagtataaatcttattagggcacaatatgaaaataaaaataagaactttatacaaaagctttttttatacaatatgcttcttgcgctattaagttaagaaattttatttatgcttgtaaaaaaacaataaatgctttatttattaa

SEQ ID NO: 596 - DNA, 498 bp, Ctenocephalides felis
  misc_feature (482)..(482): n = unknown
tacaagtgcaaacttggtctaaatggtgctctgcaaagcggtcattttttatgcccatggaacttgtatataagtgagttttaccaaagatgtgtgggccctacatattcggaatgtttaattacacctctgcctcctccaattgttccgactactacgactacgacaactacaccagcaccgccgcctcttttttcatgcgtgcaggaagggatgtttatagatccctatgacagcacttgcaaaggatactacaaatgtgctttgaaagcaggcggaggattcagtgtagcgcgttacaattgtcctggttctacttacttcagcagcacgtatcagcaatgtgtggtcgcttcctttcggagtgcctaagaaatcctcagcgccttggcaaccacctacgccggcgccatatacaactgcgtgcagagcggtcatttgcagatccagcagacaaaacatgcaaagtatattttgaatgngtgagactctctggag

SEQ ID NO: 597 - DNA, 500 bp, Ctenocephalides felis
ccggcccgccgtgtgctggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgcttctgtttttgctcacccagaaaccgctggtgaaagtaaaagatgctgaagatcagttgg

SEQ ID NO: 598 - DNA, 240 bp, Ctenocephalides felis
  misc_feature (41)..(41): n = unknown
  misc_feature (84)..(84): n = unknown
  misc_feature (99)..(99): n = unknown
  misc_feature (111)..(111): n = unknown
  misc_feature (188)..(188): n = unknown
  misc_feature (196)..(196): n = unknown
tttttttttttttttttttttttttttttcctatttatatntttatattcaccaattatgacataactactattatatattaanaatgatttttaaagnaatcaataatanaaagccttgattacttggaaatgatattaacactaacaacttggagtttcataacttgaataaataataaattttgnaatggttntatcaaacaagtttatgcttttttacaacataatcaaaagttac

SEQ ID NO: 599 - DNA, 167 bp, Ctenocephalides felis
ctgggtaacatatttattagaatgttttatatcacattggtttttattagttttgtggcgttatctgtcgttaccgcttatgatggtgagtttaatgtcgacggaacgcctttaacagtaaataaagaagtatttgcatcattggatgagcccgcaccaggagtagt

SEQ ID NO: 600 - DNA, 380 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatg

SEQ ID NO: 601 - DNA, 498 bp, Ctenocephalides felis
gaggaggactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatata

SEQ ID NO: 602 - DNA, 377 bp, Ctenocephalides felis
  misc_feature (362)..(363): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaaaaaaaaaaaannaaaaaaaaaaaaaa

SEQ ID NO: 603 - DNA, 384 bp, Ctenocephalides felis
tgaaatgtgaagacgacgtcaacgaatggtttgacccaaaatctttctcgtgcagaactgcatacaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaaaaaaaaaaaaaaaaaaaaaaaaaa

SEQ ID NO: 604 - DNA, 269 bp, Ctenocephalides felis; identical to SEQ ID NO: 441

SEQ ID NO: 605 - DNA, 500 bp, Ctenocephalides felis
  misc_feature (247)..(247): n = unknown
  misc_feature (400)..(400): n = unknown
  misc_feature (491)..(491): n = unknown
ttttttttttttttttttttttgtatatcatataagttatatttcgtatacattttgtggtttgtggtccatattttaatttgctacttaacatattctatgattatggatttattcaaaattaatttatccaaacagcttataaaattgtatttatcttttatccattcaacaataaaatgttaacaaaaaaatacacatagaaatcttttcagacatggccatttaaacattttttcattaaggntatcaaaaatatatcaggcatggccatttatacattttttttattagggcatcaaaaaaatagtataatttctatgttattattcaaaatctatacattaataaggatgttagaagtttgttcggttaattttcaggcagaggttgctattgnagtaatagaacaattttaatcatctaaaatttgattaatctattacatttaatcattcaatagtaaatttccttttggaatttcgaatggntgccattac

SEQ ID NO: 606 - DNA, 343 bp, Ctenocephalides felis
gtattcaatggtatgaattgcttggtgaatgaaaatttcactcatgggttcttcttcgtgttctccatgagctgcttttggcggtgcctttggtgcctctggcataccgttttcttggctggagacaacgtctgaagtcatttccattccttggttcaaatcaccatttgatttagcagaatgaggagcttcatctttatttttcttggttgccatcaaatataatggtttgcccaagagcatgagcggaatacagcagagcccaattaacacaaatattttttgaatttgctgttgtccttcaaacataaattcatcgcaatgttctgctggagatccttgc

SEQ ID NO: 607 - DNA, 439 bp, Ctenocephalides felis
  misc_feature (84)..(84): n = unknown
  misc_feature (86)..(86): n = unknown
  misc_feature (152)..(152): n = unknown
  misc_feature (182)..(182): n = unknown
  misc_feature (215)..(215): n = unknown
  misc_feature (224)..(224): n = unknown
  misc_feature (229)..(229): n = unknown
  misc_feature (329)..(329): n = unknown
  misc_feature (342)..(342): n = unknown
  misc_feature (344)..(344): n = unknown
  misc_feature (347)..(347): n = unknown
  misc_feature (360)..(360): n = unknown
ttttttttttttttttttttttttttttctatatttatatattttaaataatcagaaattactatagttaatgacattttgttngngctccttacataaaatacaattttatacattttaatttttatacatattttttatatttaattgcncagatcatttgggtatttattatattaatngactactttatgataatttgaatcctaattagnctattcaanattgntttcctggtttaagccttacttagcaatctcacttttgcattcttcgccgggtggcgtgggtatgcatcgcaactccgtttatcaaagtgcaagccattnggacaatcataangnttnatttgccatttgntgttaaccaagaaacattgataatattttttacaatctcttcgatcggaaaaaacgttttccttttgcatgcagtctgc

SEQ ID NO: 608 - DNA, 498 bp, Ctenocephalides felis
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcaacaaagctgaaatggaggagagtgatacagatcaaagtccagatcgaaaaaatactcctgatcacatgaaggacactgatgtgaggcataggaagtaaaccaaaaatttaatctagttgaataaaagttaatgcaccagagtagaagt

SEQ ID NO: 609 - DNA, 500 bp, Ctenocephalides felis
  misc_feature (153)..(153): n = unknown
  misc_feature (231)..(231): n = unknown
  misc_feature (291)..(291): n = unknown
  misc_feature (411)..(411): n = unknown
  misc_feature (427)..(427): n = unknown
  misc_feature (430)..(430): n = unknown
tttttttttttttttttttttttttttttttttacaaaggaacggcccaaacgatttatttttattaaaaagatacatgtaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaanattggtttcctggtttaagccttacttagcaatctcacttttgcattcttcgccgggtggcgtgggtatgcatcgcaactccgtttatcaaagtgcaagccatttggacaatcataatgntttatttgccatttgntgntaaccaagaaacattgataatattttttacaatctcttcgatcggaaaaaacgttcacttttgcatgcag

SEQ ID NO: 610 - DNA, 500 bp, Ctenocephalides felis
  misc_feature (68)..(68): n = unknown
  misc_feature (146)..(146): n = unknown
  misc_feature (224)..(224): n = unknown
ttttttttttttttttttttttttttttttctgaacggcccaaacgatttatttttattaaaaagatncatgtaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattggtttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaacgtttcactttgcatgcagttctgca

SEQ ID NO: 611 - DNA, 500 bp, Ctenocephalides felis
  misc_feature (81)..(81): n = unknown
  misc_feature (83)..(83): n = unknown
  misc_feature (101)..(101): n = unknown
  misc_feature (167)..(167): n = unknown
  misc_feature (179)..(179): n = unknown
  misc_feature (244)..(244): n = unknown
  misc_feature (360)..(360): n = unknown
  misc_feature (461)..(461): n = unknown
  misc_feature (465)..(465): n = unknown
ttttttttttttttttttttttttttttaatttcataaagcttctatatttatatattttaaataatcagaaattactatngntaatgacattttgtttgngctccttacataaaatacaattttatacattttaatttttatacatattttttatatttaattgcncagatcatttgngtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttgttgttaaccaagaaacattgataatattttttacaatctcttcgatcggaaaaaacgtttcacttttgcatgcagttctgcacganaaanatttgggcaaaccatcgtgacgcgcttcacatttc

SEQ ID NO: 612 - DNA, 104 bp, Ctenocephalides felis
aatccagggagaccatcagacttgaagattttggtcaagcagttgcccaatccagagaattcacgttgaccagcgcctttacctacatcagcggccaatctggt

SEQ ID NO: 613 - DNA, 277 bp, Ctenocephalides felis
  misc_feature (28)..(28): n = unknown
  misc_feature (62)..(62): n = unknown
  misc_feature (64)..(64): n = unknown
  misc_feature (71)..(71): n = unknown
  misc_feature (188)..(188): n = unknown
  misc_feature (202)..(202): n = unknown
gaggaacagcccaacaacctcgtctgtntgttggaatgatcttgatcctgatcttcgctgangnattgggnctatatggtcttatcgtagccatctacctctacaccaaataaacaaattattatggatttcaagatacacaagtcgcctgcctcccaaatcccctaatatatatgcagcagtgcagnctgtctattatttntgccactcacacttaaaaatatagtggctgtaccgatatttatattatattgggttatacagaaagcactgttgt

SEQ ID NO: 614 - DNA, 386 bp, Ctenocephalides felis; identical to SEQ ID NO: 468

SEQ ID NO: 615 - DNA, 341 bp, Ctenocephalides felis
  misc_feature (28)..(28): n = unknown
  misc_feature (63)..(63): n = unknown
  misc_feature (72)..(72): n = unknown
  misc_feature (102)..(102): n = unknown
  misc_feature (116)..(118): n = unknown
  misc_feature (142)..(142): n = unknown
  misc_feature (152)..(153): n = unknown
  misc_feature (170)..(170): n = unknown
  misc_feature (235)..(235): n = unknown
  misc_feature (273)..(273): n = unknown
ataaaggaacggcccaaacgatttattnttattaaaaagatacatgtaatttcataaagcttngatatttanggattttaaataatcagaaattactatagntaatgacattttgnnngtgctccttacataaaatacaatnttatacattnnaatttttatacatattntttatatttaattgcacagatcatttgtgtatctattatattaattgactactttatgataattngaatcctaattagtctattcaagattgttttcctggtntaagccttacttagcaatctcacttttgcattcttcgccgggtggcgtgggtacgcatcgaaactccg

SEQ ID NO: 616 - DNA, 221 bp, Ctenocephalides felis
tatataatccgattctcgatttgtatcttcataactgattctcagatatccattaccggaatgttcatcatcacgtctaagctgtccactaaattcaactttttctccattttctttcatgacatgtctgaattttatttttccttcaactaaagattccatgtgagctcttgcgcaagttccatctcgttcaaaatgattttggtatctatattgttcgt

SEQ ID NO: 617 - DNA, 173 bp, Ctenocephalides felis; identical to SEQ ID NO: 395

SEQ ID NO: 618 - DNA, 422 bp, Ctenocephalides felis
taataagcagttgggaacattttgtcacgattgttctactttgaagttgtgcgctggacaagaaaccccaattacaacaatcaattgcagagactcaaattccgatgctccattttgtgtagatgatatgtgctcatcaaaacctggggaaaactgtaagacggcagaaactacatgcgcggttgtaggatatcagccagatccgaaagactgcacaagatacttattctgcaagatggtaaaggtcaggttttcgaatgcccacctaactatgtatatgatcattctaaaaatatgtgtaaaaagaaatcgtcagaagctgattgcaccgtcatgaaatgcacaaatcccaattcttttataacctatgcaccggacccatcaatttatgcttggtgcaatgaccaattgtaaccgatcgt

SEQ ID NO: 619 - DNA, 493 bp, Ctenocephalides felis
  misc_feature (462)..(462): n = unknown
  misc_feature (481)..(481): n = unknown
aatagtgctaaccaaagcaaagataaaccaatctcgcgtcgcccacatcagtaacggcataagaatcattccactggtccacccgatggactgcatcatggcaatgtgtgctctatcttcacttctggatatttccatcgcaattatcaaagggctttgaaaaacagatgtagatgttagtgaaccaagaaaagccgctgttataaaaacaataaaccaactggaagtaaatgctgtaattagtcttccggtgacgattgtgatgagacttaagtaaaatactggtcttcttccaatcctatctcctaattgtccaaaaataaatgtgcctatgacttcgcctgcacgtccaatagcaaatgtattagttacatagagttctctatcacaaacccagtcttgatctgacggacccgttgataaataccatgttctgcatattcataaccatgctgacaaggnattatttgactttcaatcntattgctcttca

SEQ ID NO: 620 - DNA, 350 bp, Ctenocephalides felis
agcaaaaccaagtgtatttgaatttcatttttgcacaagttacctttttgtattaaaatatatgtatatttatgaatatgtatttcttgtattttaggttaaattcgttatagaataatttggaaatacatattcataatgctaaagtattaaattggcttttttccattaaaatcctatttaacattatacatatattttattgtcaaatgtgaggcggtatggaatcacgggtggctgctttctgagtagtcgaaccttttaggcaaaaattgtgtagatcaaactcagttctacaatcttgagctcatccacattctcagaacatccatgtatttaagttaacttat

SEQ ID NO: 621 - DNA, 251 bp, Ctenocephalides felis
  misc_feature (70)..(70): n = unknown
tttccgtaatgatgatggtgggcgcgacttccggaatgttcttgccggaaactttacaccaaaagttacnggaaacgctaactgaagctcacgtattcggcagggatcaggtgttctggagcttaccgaaaaaaggtgtatcaaagtctacagatacggccgtcaagaaattatcacaagaagactgttaaatagttataatttgtattgttatacatatgtttcttatataataaaattatatttattgt

SEQ ID NO: 622 - DNA, 498 bp, Ctenocephalides felis
tgaaatgtgaagacgacgtcaacgaatggtttgacccaaaatctttctcgtgcagaactgcatgcaaaggtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaatacatgtatctttttaataa

SEQ ID NO: 623 - DNA, 131 bp, Ctenocephalides felis; identical to SEQ ID NO: 515

SEQ ID NO: 624 - DNA, 489 bp, Ctenocephalides felis
  misc_feature (381)..(381): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgnataaaattgtattttatgtaaggagcacaaacaaaatgtcattaactatagtaatttctgattatttaaaatatataaatatagaagctttatgaaattaaaaaaaaa

SEQ ID NO: 625 - DNA, 230 bp, Ctenocephalides felis
  misc_feature (69)..(69): n = unknown
ttttttttttttttttttttttttttgtgtaaaatatttattgaagtataattactataattttataanacaatcaagtactattttcatatatatcttgccatttatcaaaatcagtccctttaatatttttcttcatccattcatctacttttaaggccaattccaagctcatttcttttctccagcttccaacttgaccttttctcataaattctctgtcagttggt

SEQ ID NO: 626 - DNA, 401 bp, Ctenocephalides felis
  misc_feature (32)..(32): n = unknown
  misc_feature (49)..(49): n = unknown
  misc_feature (57)..(57): n = unknown
  misc_feature (89)..(89): n = unknown
  misc_feature (148)..(148): n = unknown
  misc_feature (152)..(152): n = unknown
  misc_feature (158)..(158): n = unknown
  misc_feature (169)..(169): n = unknown
  misc_feature (199)..(199): n = unknown
  misc_feature (218)..(218): n = unknown
  misc_feature (301)..(301): n = unknown
  misc_feature (343)..(343): n = unknown
  misc_feature (348)..(348): n = unknown
  misc_feature (360)..(360): n = unknown
  misc_feature (362)..(362): n = unknown
  misc_feature (364)..(364): n = unknown
ttttttttttttttttgatttcataaagcttntatatttatatattttngataatcngaaattactatagttaatgacattttgtttgngctccttacataaaatacaattttatacattttaatttttatacatattttttatattnaatngcacanatcatttgtgnatttattatattaattgactactttatganaattcgaatcctaattagnctattcaagattgttttcctggtttaagccttacttagcaatctcacttttgcattcttcgccgggtggcgtgggtatgcatngtaactccgttttatcaaagtgcaagccatttggacaatcanaaggntttatttgccantngntggaaccaagaaacattgataatattttttacaatct

SEQ ID NO: 627 - DNA, 466 bp, Ctenocephalides felis
cgaaagataaggactccgattgttctgagagcgggctttggggcaatgtggaggcgcaggccgccttcctggggcctaatatatgggataagacattaccctatgatgctgatctcaagtatgtggatctagatgagttcctttctgagaatggaatccctgtggatggaatgggtcacagcggtggattggggtccatgagtcacttaggtggcttaggaggatctcataggtctgaggctttaggtcaccctttgagtggtatgccaacacatctaacaaagattgaaagatcaccttcaccttccgaatgcatgagcccggatactatgaatcctgcttctccagctgattcaacattctcaatggcttcttctgggccgagattttgatcctcgaacacgggctttttcggatgaagaactaaagcctcaacctatgatcaagaaaagtagaaagcagtttg

SEQ ID NO: 628 - DNA, 498 bp, Ctenocephalides felis
  misc_feature (71)..(71): n = unknown
acatacaccaaaatatctaaaactaaatatttggctcttacaattgataatttgtattagaagcatccaangaagcatcttgtaaacaactatgcatctgtgaaatctatgttgattttgaacatcagattggggatgtcattgaaacaaaagttaaagacagattcatgaattactgaaaatctgaaaaacaaactgaaggaatttgttgcacatttatctgacctcccaacatctttaaatatgatctagtattaagcataagaattcaaaatatacaacctttccgttaccaatctaatgtagacaaaaagcaattactggcaatatttaaacttaattttgcatatggataagtcctattgtctagccaacaaacaaaaatgctgacaatctagtatgtctgaaaaacatcaaaagctgttcttttggaaacacatcaaacaaagtattaaacaaaccttttctataaagctctaaaaataaaaaaaagtagaa

SEQ ID NO: 629 - DNA, 498 bp, Ctenocephalides felis
  misc_feature (37)..(38): n = unknown
  misc_feature (377)..(377): n = unknown
  misc_feature (391)..(391): n = unknown
  misc_feature (479)..(479): n = unknown
  misc_feature (482)..(482): n = unknown
tgaaatgtgaagacgacgtcaacgaatggtttgaccnnaaatctttctcgtgcagaactgcatgcaaaggtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaanatgtataaaattgnattttatgtaaggagcacaaacaaaatgtcattaactatagtaatttctgattattaaaatatataatatagaactttatgaaatacntgnatcttttaataaaata

SEQ ID NO: 630 - DNA, 498 bp, Ctenocephalides felis
acatacaccaaaatatctaaaactaaatatttggctcttacaattgataatttgtattagaagcatccaatgaagcatcttgtaaacaactatgcatctgtgaaatctatgttgattttgaacatcagattggggatgtcattgaaacaaaagttaaagacagattcatgaattactgaaaatctgaaaaacaaactgaaggaatttgttgcacatttatctgacctcccaacatctttaaatatgatctagtattaagcataagaattcaaaatatacaacctttccgttaccaatctaatgtagacaaaaagcaattactggcaatatttaaacttaattttgcatatggataagtcctattgtttagccaacaaacaaaaatgctgacaatctagtatgtctgaaaaacatcaaaagctgttcttttggaaacacatcaaacaaagtattaaacaaaccttttctataaagctctaaaaataaaaaaaagttaga

SEQ ID NO: 631 - DNA, 386 bp, Ctenocephalides felis
  misc_feature (360)..(360): n = unknown
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcaaaagcaagtggatagaagaacgagcattgcttcatatggaccataaccatatttccgtcgtgtgttgtgaaatgcaattatactttgagaaagtattatcgattacaaagaaaattcagaagttgctactgaatcattttctaaaacatcgacatgaaaattaataactctttattgntattagattcgatgtaagatatatgt

SEQ ID NO: 632 - DNA, 498 bp, Ctenocephalides felis
  misc_feature (69)..(69): n = unknown
gaggagactttgtttaccgtaatggacaaccattcgaaattccaaaaggaaatttactattgaatgatnaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatatacttatatgatatatg

SEQ ID NO: 633 - DNA, 498 bp, Ctenocephalides felis
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctctgtggccatttttgggtatctgtgctgaagtaataattttatgcgcgattattctcatttatgaaaagaaacgcaacaaagctgaaatggaggagagtgatacagatcaaagtccagatcgaaaaaatactcctgatcacatgaaggacactgatgtgaggcataggaagtaaaccaaaaatttaatctagttgaataaaagttaatgcccagagtagaagta

SEQ ID NO: 634 - DNA, 395 bp, Ctenocephalides felis
atattatattcacaataatctaatcttccaagttgcggaatgcttgctgtaaatcctcatgtaattgatcaaaatcactcttgatctttgcctcaccatccttgactgggtccttgaacttcattgaggacaactgatatagaatattgcccatagcatctctaatggtattccaggtaatcttgttttcactttgtgcagtagattcaactgcgtattttgccatatcatagaaagcaataatgttacgtaacataccaactgttttatagaaggggcagaaacgatcatatgatgagtagctgttctgctgtaggaaatcgtctttcaagagcttggcaacttcaagtgtgatcttgtcagtttccgccaaggaggctttaccaaccaattgt

SEQ ID NO: 635 - DNA, 386 bp, Ctenocephalides felis
  misc_feature (360)..(360): n = unknown
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgntattagattcgatgtaagatatatgt

SEQ ID NO: 636 - DNA, 354 bp, Ctenocephalides felis
ccgggcaggtacaatactttgaatacttcataaagaccgaatttgcaaagaccctgcatggagtatccaacaaaggttggagcccaacctttagcaagacctctagcaccatcttccgctagagttactttgaatccattgaatactgatttgtattttgcaggatctacttgaatacggcatttcactaaatcaagtggaacgaccatggtgtgtgttacaccgcaagaaataattcctccaaatccgcaaagagcaaagtaatgaccagatccaaaggcacaggaatctcctgttgcatctgaggtggaggctgccattgttgccaatgatttagattcagcttcacattgt

SEQ ID NO: 637 - DNA, 498 bp, Ctenocephalides felis
  misc_feature (69)..(69): n = unknown
ttcttcacgggcagctgatacctcacgcaaagcttcagcatatgaggacatgtctgttaagattaccancacgtgcttttcacattggtaggccaagaattcagcagctgtcaaagccagacgtggggtaatgatacgttcaatagttggatcattggccaagttcaagaacaggcacacattctccatggaaccattctcctcgaaatcttgtttgaagaatctggcagtttccatgttgacacccatagcggcgaacacaatggcaaagttatcctcatggtcatccaaaactgattttcctgggattttaactaaacctgcttgcctacagatctgggcagcaatttcattgtggggcagaccagctgcagagaaaataggaatcttctgtccacgagcaatggagttcatcacatcaatagcagagataccagtttggatcatttcctcaggatagatacgagaccagggattgatgggttgaccttggatgtc

SEQ ID NO: 638 - DNA, 479 bp, Ctenocephalides felis
ttattgcagtcaataaaaatagatacatagtagctgatcataaattattaattgaaaatttaataattttttatttgttatttaaattagcattcgagtccgccctcacctccagctccaccgatcatgtccaaaatttcttgaagagtgaattggctcaaaattggattgataagatcctttgcagctgagtctacggtattggaaattaattcttggttttctttgatcaattctggtaaagtttcgtttaagaaagcgttgatttcacttgtgagttctgggtcgttcattattccatcgatagcgaacttcatatctccaacagtgagcaaaagttttaattctgctaattcaacgtatgtaagatttttcaaacgcaatttgatatgtccggatgctgtgatttggtttaattgaatatcgaaaggccttttccgaataatgggtcagctgcaaccaagtttgcaatgaggtcg

SEQ ID NO: 639 - DNA, 498 bp, Ctenocephalides felis
aacaatatgtaaccgattccacactatttttaacagaattcaaaattcgtaattgtcaagaaattatttcatctctacagaatgttttatgtgatcaagaagtcaagtatattccaaagcggaaatttgggttcaaaaataaaaagctcttattaaatgataaaattattggtaaggacttggatacaaaaagtaaagatacgacagatttatgtctcaataagtgtaatgattggaatttatcagaatgtggatttcatttaaaggagaatgaaattctatatctttatgctgaacaggttaataaaaaggatattacattgagtagcatatataaatgcactgtaataattactggctatcctaatactcttcacatgtcaaacattcaagacagcactgtgatttgtggtcctgtaactacatcaatatttgctgataaatgcattaatagtaagttagtcattgcttgccacaattgagactacattcttctaa

SEQ ID NO: 640 - DNA, 498 bp, Ctenocephalides felis
aataaatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagtacagcgtacggatatctggcgtcatatgtggttcccaagtatacaatgtatgggcctaatactcctaatgcatttgaaactatagttccaatggaaattcctgtctgctcaaacaggttggatatgtttccattgcttgcagattcacaacataaaacgtgatgcttatgcaaaatttcattaccacggctaacagtgggaccaaattctggagggattcatcattggcaatgcatataagaatgga

SEQ ID NO: 641 - DNA, 491 bp, Ctenocephalides felis
  misc_feature (8)..(8): n = unknown
  misc_feature (14)..(14): n = unknown
  misc_feature (61)..(61): n = unknown
  misc_feature (65)..(65): n = unknown
  misc_feature (152)..(152): n = unknown
  misc_feature (176)..(176): n = unknown
  misc_feature (330)..(330): n = unknown
  misc_feature (355)..(355): n = unknown
  misc_feature (384)..(384): n = unknown
  misc_feature (458)..(458): n = unknown
tttttttntttttnttttttcttttcataaagcttctatatttatatattttaaataatcngaanttactatagttaatgacattttgtttgtgctccttacataaaatacaattttatacattttaatttttatacatattttttatattnaattgcacagatcatttgtgtatntattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcangccatttggacaatcataatgtttnatttgccatttgttgttaaccaagaaacnttgataatattttttacaatctcttcgatcggaaaaaacgttttcacttttgcatgcagttctgcacgagaaanttttgggcaaaccattcgtgacgcgcttccatt

SEQ ID NO: 642 - DNA, 331 bp, Ctenocephalides felis
  misc_feature (30)..(30): n = unknown
  misc_feature (37)..(37): n = unknown
  misc_feature (71)..(71): n = unknown
  misc_feature (82)..(82): n = unknown
  misc_feature (108)..(108): n = unknown
  misc_feature (205)..(205): n = unknown
  misc_feature (249)..(249): n = unknown
  misc_feature (265)..(265): n = unknown
  misc_feature (294)..(294): n = unknown
  misc_feature (297)..(297): n = unknown
atggaatagtgctaaccaaagcaaagatanaccaatntcgcgtcgcccacatcagtaacggcataagaatnattccactggnccacccgatggactgcatcatggcantgtgtgctctatcttcacttctggatatttccatcgcaattatcaaagggctttgaaaaacagatgtagatgttagtgaaccaagaaaagccgctgntataaaaacaataagccaactggaagtaaatgctgtaattagtnttccggtgacgattgngatgagacttaagtaaaatactggtcttnttncaatcctgtctcctaattgaccaaagataaatgt

SEQ ID NO: 643 - DNA, 489 bp, Ctenocephalides felis
  misc_feature (387)..(387): n = unknown
  misc_feature (392)..(392): n = unknown
tgttgacacgatttttcgagttttaactgaccgatccacttaaaatgttcagagagtcttgtttatagacctatctatagcccgaactaggattatcccccaattccaattttcactatttttaaaacattcgagaaactaaaaaaacagtaaaaaaacacttttttttcaaatagtcgaaaatttgtaaacaaacatttttttactcatcgccagttcaggcgattgcgacatcattgtagattaataatctttttattttttgcatttccgatggctaggagggctgaaatcatgtcaagactgaagtgccaattttttgagaccacccacttcatcagctgccagtttttacaattttcaacttttttattttttaatttttgntttgnattttaataatattaataaacaagtggtaaaaaaacggatagtaaaaacattcattggtttcttttacgacactttaaaaatgacctaaaattcatc

SEQ ID NO: 644 - DNA, 336 bp, Ctenocephalides felis
aattgttgtgggtcaacttggtcactgatggtttaccagctactgccttaggtttcaacccaccggacttggacattatggacaaaccaccacgtaaagctgatgaaggtcttatctctggatggttgttcttcagatacatggctattggagggtatgtaggtgctgctactgttggagctgccagttggtggttcatgtattctccatatggtccacaaatgagctactggcaacttactcatcacttgcaatgtcttggtggtggtgacgaatttaaggagtcgattgtggtattttcactgaccctcatccaatgaccatggctttgtctgt

SEQ ID NO: 645 - DNA, 460 bp, Ctenocephalides felis
  misc_feature (94)..(94): n = unknown
cttcggcttttcgcggtagcgttccgaggtgcccattgaagatttaaaaggccgcagtaatttgactgtgcaaaggtagcataatcaatagttntttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattt

SEQ ID NO: 646 - DNA, 394 bp, Ctenocephalides felis
caggtcgaataatatttctaattgtttcaatacaaactataaaaggtattaaaattattggagttccttgaggcactagatgactaaatatatggttataattattaattcatcctaataatataaatcttaatcataaaggaagtcttaatcttaaagttaaagttaaatgactagttcttgtaaaaatgtaattaaataatcctaaaaaattattaaataaaataaatgaaaataatctaataaatataaaagttcttcctataggattatattttataagtaatttaaattcattatgaagtgttataataatttttaatcaaattatgttgtatcgggacggaattattcaaaatatatttggaataaataatagtcctaatcccccccg

SEQ ID NO: 647 - DNA, 368 bp, Ctenocephalides felis
agtaaactaccacacaacaataatttgtacaatttgtaactttatcaactctttacagcatttattgtaagttgtaacaaacacttcatttatccgtaaggataatgtgaactaaatcataattcgttttagtattataagtccgtgctattgttagttaattatcgataggatttttgtgttattcatttgaggaaaaataggcggaggccgatatcatcaaattgctgtgttgccttcaaggatttaccaacttataataaataatagaagtccaaatcatttattaattaagaacgcgtcatcttgcaatttgattactctgtgataagagtaacgagtaaaagttacatatacaattaaacagt

SEQ ID NO: 648 - DNA, 332 bp, Ctenocephalides felis
caggtcgaataatatttctaattgtttcaatacaaactataaaaggtattaaaattattggagttccttgaggcactagatgactaaatatatggttataattattaattcatcctaataatataaatcttaatcataaaggaagtcttaatcttaaagttaaagttaaatgactagttcttgtaaaaatgtaattaaataatcctaaaaaattattaaataaaataaatgaaaataatctaataaatataaaagttcttcctataggattatattttataagtaatttaaattcattatgaagtgttataataatttttaaggaaactatg

SEQ ID NO: 649 - DNA, 357 bp, Ctenocephalides felis
atatacatatttatgatccttctattagtagattatataattaggtttttgtctttgaactgattatctgcaaataacgtaaattagaaaacgcacaagagaaaatgtttatatgattccgatatttactcactatttatttttcacaaagcatagaattagtttttatatgatgcttgatcaataatggtgtttgaaattttaaaattaatatacgaagctatttaatatcacgcaaagaaactttgatgtttataagacacctatgtttacacatacatacacatatattgtaaatattaatacttctttataaaatccatgcatatttgctttgtcatattcttattattctgt

SEQ ID NO: 650 - DNA, 498 bp, Ctenocephalides felis
  misc_feature (440)..(440): n = unknown
  misc_feature (473)..(473): n = unknown
taattaattttaaaaaattaaggatagaaaccaacctggcttaaaccggtttgaactcagatcatgtaggaattaatggtcgaacagaccaaattttaaaacttctgcattttaaaattatcttaatccaacatcgaggtcgcaatctattttgtcgatatgttctcttaaaaataattacgctgttatcccttaagtaacttaatcttttaatcataatttatggatcaattattcaattatttatgttttaataaaaaaaaagttttataaattttcctatcaccccaataaaatatattaatataaataaatttaataatattcttaaaattaatctatatttatatataaaactttaaagggtcttctcgcctttaataatatttacgctttttaacataaaaattaaattctataacaacttttattaagacagntaatatttcattcaatcattcattccagctttnaattaaaaaactattgattatgcta

SEQ ID NO: 651 - DNA, 498 bp, Ctenocephalides felis
  misc_feature (477)..(477): n = unknown
  misc_feature (486)..(486): n = unknown
taattaattttaaaaaattaaggatagaaaccaacctggcttaaaccggtttgaactcagatcatgtaagaattaatggtcgaacagaccaaattttaaaacttctgcattttaaaattatcttaatccaacatcgaggtcgcaatctattttgtcgatatgttctcttaaaaataattacgctgttatcccttaagtaacttaatcttttaatcataatttatggatcaattattcaattatttatgttttaataaaaaaaagttttataaattttcctatcaccccaataaaatatattaatataaataaatttaataatattcttaaaattaatctatatttatatataaaactttaaagggtcttctcgcctttaataatatttacgctttttacataaaaattaaattctatagcaattttattaagacagttaatatttcattcaatcattcattccagctttcaattaanaactattgntatgctcctttg

SEQ ID NO: 652 - DNA, 498 bp, Ctenocephalides felis
taattaattttaaaaaattaaggatagaaaccaacctggcttaaaccggtttgaactcagatcatgtaagaattaatggtcgaacagaccaaattttaaaacttctgcattttaaaattatcttaatccaacatcgaggtcgcaatctattttgtcgatatgttctcttaaaaataattacgctgttatcccttaagtaacttaatcttttaatcataatttatggatcaattattcaattatttatgttttaataaaaaaaaagttttataaattttcctatcaccccaataaaatatattaatataaataaatttaataatattcttaaaattaatctatatttatatataaaactttaaagggtcttctcgtcctttaataatatttacgctttttaacataaaaattaaattctataacaattttattaagacagttaatatttcattcaatcattcattccagctttcaattaaaaaactattgattatgcta

SEQ ID NO: 653 - DNA, 498 bp, Ctenocephalides felis
acaaaattagaaaaatttaattaaggatctgcgataaaaaaaaaacaatttttgacacatgaaacaattttctaaatcatttttctatttcatgttcaagagaacagacggacagacgaacagatagataaacaggtggacacttaacacgttaatcgccatgataatatcagaaaaaaatttacatgcactatggtaactttattagttgaaaatgtatcgaaaactccatgtagcaaagaaaaaaagatattttgaaaaattcctgcacattatttttttatgccacatatatatgactgatatatatgtcagacataatttataaactagtcggtttggtatttagccttgagggcaagttacatgaacttcccgatatgtttaaataatcaacttaatcaataaaaaataaattaatttatgagtcattaaaagtattccgagtggatttattatacataattgaaaacgaacgacactttgactcggagtatt

SEQ ID NO: 654 - DNA, 498 bp, Ctenocephalides felis
  misc_feature (18)..(18): n = unknown
  misc_feature (472)..(472): n = unknown
tcggtccgacacgctagnatgcgaagagcgaacgaaatttcttactatgagcggttgcaacgctagttttatatttattataaaactataataaaattataatttattctttaaaattattttcgatacgtaaatacgtatatattacataaatatatggtattttattaaagacgatatgttttacgtcagcatttttggtaaacaaactatttcttttaatactatattaccatttatatattttgctatctttgtatttattgcgtttcgataattcatataatttaattttcaaatacaatgttaaaaataagctattacatttttacaagcaatcgaacgtagcttataaaatcatattattatttatgtaattaactattaggtttgcactaatttatacaccataaaaattaatttcgtataatattaaaaacaatcgaattttcaacgtaaaactctagattgnatatagtatgattataagtgataaag

SEQ ID NO: 655 - DNA, 241 bp, Ctenocephalides felis
  misc_feature (219)..(219): n = unknown
acaaaattagaaaaatttaattaagggatctgcgataaaaaaaaaacaatttttgacacatgaaacaattttctaaatcatttttctatttcatgttcaagagaacagacggacagacgaacagatagataaacaggtggacacttaacacgttaatcgccatgataatatcagaaaaaaatttacatgcactatggtaactttattagttgaaaatgnatcgaaaactccatgtagcaaa

SEQ ID NO: 656 - DNA, 249 bp, Ctenocephalides felis
  misc_feature (208)..(208): n = unknown
tcgccggttggatcgtaaactgcagaaagtttcttccactcttctggtttgttgttgacgaaaaatctgattactttctcagctccttctctttgtttctcgctacatttagcgcactcgttggataaggcatcaggtaagacttttttcaattcttttccttctgctgtgcagctgcctttgtcgagaaggcagtttacatagttgntgagcaatctattgctttgcaaaatttcatctaaattgatg

SEQ ID NO: 657 - DNA, 155 bp, Ctenocephalides felis
taattaattttaaaaaattaaggatagaaaccaacctggcttaaaccggcttgaactcagatcatgtaagaattaatggtcgaacagaccaaattttaaaacttctgcattttaaaattatcttaatccaacatcgaggtcgcaatctattttgt

SEQ ID NO: 658 - DNA, 385 bp, Ctenocephalides felis
tgtcgacgatttgcaagtagttgggaatttggccgccttagataagtatccccatccagccagagtggatactgctccaattggtgtatcatagcttgccagaccaactggtttgacatagtttgtgtatacaatatttgatgtagtttttagtaaagcgatgttattgtggtatgtgttctggttaaattggttatgaacgattatttgggcaactttgtatcctactccgccagcattcaaagtgttggttccaacgacgagaagaatatcatttggatatttatttaacacgcaagtagcagcagtaagaatccaacgattgctgatgatggcaccaccacagaagtgtccttggttggttctcaaagacaccataaaaggc

SEQ ID NO: 659 - DNA, 292 bp, Ctenocephalides felis
  misc_feature (3)..(3): n = unknown
  misc_feature (75)..(75): n = unknown
  misc_feature (259)..(259): n = unknown
atntttttataaataaacgtgatttgcctagcagtcttataaaatacagttcaacaattccttatacttatcagngctttctaaaataacatacataatttaaatcaaaattaaatacgagtaacaaaagtagtaaacaaatagaattagttctaatcttcttacacctaaaaactattttagataaattgagtagatcgccattttcttttaatttaataaattcttttttatgatgtattaaatattcatatatcgnttatttaaatgtttccggtatcttataatttgt

SEQ ID NO: 660 - DNA, 315 bp, Ctenocephalides felis
atagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtactttctgtataaacaatataatataaataacgg

SEQ ID NO: 661 - DNA, 189 bp, Ctenocephalides felis
  misc_feature (79)..(79): n = unknown
aatttctgagaatcttcttcttcttacaaaatttcctttacctttgtacgtaggggcacaaattccacgaagtttttgncatagaagtcatccaaagcacgcatatatttactgtatgaaatcaaccaattgattgaagggaaatgtttcctttgagctaatttcttatccaaaccccagaacacttgt

SEQ ID NO: 662 - DNA, 405 bp, Ctenocephalides felis
  misc_feature (52)..(52): n = unknown
  misc_feature (58)..(58): n = unknown
  misc_feature (131)..(131): n = unknown
  misc_feature (134)..(134): n = unknown
  misc_feature (200)..(200): n = unknown
  misc_feature (209)..(209): n = unknown
  misc_feature (227)..(227): n = unknown
  misc_feature (274)..(274): n = unknown
  misc_feature (390)..(390): n = unknown
tttttttttttgcaaaggaacggcccaaacgatttatttttattaaaaaganacatgnaatttcataaagcttctatatttatatattttaaataatcagaaattactatagttaatgacattttgtttgngcnccttacataaaatacaattttatacattttaatttttatacatattttttatatttaattgcacanatcatttgngtatttattatattaatngactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttg

SEQ ID NO: 663 - DNA, 526 bp, Ctenocephalides felis
  misc_feature (485)..(486): n = unknown
attttagttttaattaatacgaagtctcattaatgaaataattaatgacgactttaggataattatttatatacatttttataagaaaagactcattattttataagtatttaaatttcaaaatcaagtttttgggatggagcagaagaataaatatatttattatatcgctcgactgttatacgatgagattttcttatgaaagtggttccctggtcgtgttaggcaaaaatagacacatcagaccacctccagccaatagtagtgctacaataaatgtcggggctggcaatacatgtctaataaagttgcaattaccacattgccaattatgcctccaagtcgagcagctccatagatattgccacaccagtagccctcaaatttggtggaaacacctcggtgataagacagccacgctgcattttcacaagatataacagagctgaagactgcagacacgattaaattgtgacgtttattgnnaacaaagaacatgcaggctggcacactcctggtgtaaaag

SEQ ID NO: 664 - DNA, 251 bp, Ctenocephalides felis
tttccgtaatgatgatggtgggcgcgacttccggaatgttcttgccggaaactttacaccaaaagttaccggaaacgctaactgaagctcacgtattcggcagggatcaggtgttctggagcttaccgaaaaaaggtgtatcaaagtctacagatacggccgtcaagaaattatcacaagaagactgttaaatagttataatttgtattgttatacatatgtttcttatataataaaattatatttattgt

SEQ ID NO: 665 - DNA, 409 bp, Ctenocephalides felis
  misc_feature (7)..(7): n = unknown
  misc_feature (11)..(11): n = unknown
  misc_feature (16)..(16): n = unknown
  misc_feature (42)..(42): n = unknown
  misc_feature (50)..(50): n = unknown
  misc_feature (113)..(113): n = unknown
  misc_feature (122)..(122): n = unknown
  misc_feature (384)..(384): n = unknown
  misc_feature (400)..(400): n = unknown
ctaagcnttgnaactntttttaaatctcacgggttttggggnaagtctcntaaattgcctgcaagaatgagtttcagggaacgaaaagaatcggccaaatgcatgcaaaaggntgcattaantatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaaccttggnaaaaaaaaaaaaaaanaaaaaaaaa

SEQ ID NO: 666 - DNA, 447 bp, Ctenocephalides felis
  misc_feature (193)..(193): n = unknown
tttttttttttttttttttttttgacaattttacttgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcanaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatacatattcataaatatacatatattttaatacaaaaaggtaacttgtgcaaaaatgaaattcaaatcacttggttttgctaatttaaattg

SEQ ID NO: 667 - DNA, 431 bp, Ctenocephalides felis
  misc_feature (66)..(66): n = unknown
  misc_feature (90)..(91): n = unknown
  misc_feature (105)..(105): n = unknown
  misc_feature (147)..(147): n = unknown
  misc_feature (234)..(234): n = unknown
gtgggccggccgggcgggacacacaattagcaataggaaaatctagcccaaatatttttaacaatntatttaatacttatgggctagaanngcaaagtgtaaagntcaaggtttgtatagcttaataaagtaaacattttaaaatgnaatgaatttatctgcaaatagtcaaaatcaaaattactatataatgattattgaaataatgcttttatagattgcatttcaatctgnattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatataaataacgg

SEQ ID NO: 668 - DNA, 383 bp, Ctenocephalides felis
  misc_feature (89)..(89): n = unknown
ttttttttttttttttttttttaatgctgtatataacctttatttatggatgcatagatagatgtgtgccaaatttaaaatactattgnatatttaattttttttctatattcacattttcattatatttctaatctaatatccccaaatttcaactaagaagttaaatcctttgccagtctgagaagataggagtaaagttacatttttccagccaactccaccattgacaagagtggcatagcctccttggccatttacatattggtccagggcacgaacacagctaattgtgcgattatttctcgatcccactggtggaaatgacacctctctagtagctttcctgaaaaagtttccactcttggattggacttgacggt

SEQ ID NO: 669 - DNA, 218 bp, Ctenocephalides felis
  misc_feature (76)..(76): n = unknown
  misc_feature (83)..(83): n = unknown
  misc_feature (94)..(94): n = unknown
  misc_feature (122)..(122): n = unknown
  misc_feature (211)..(211): n = unknown
gctttgttttacttttatgtgttatataaaaaaatattatgggtgaacacaggctcgcaaatatgataaggcattnaagaatnttacaatttanatttttttaaatccatgaatatatttgntctaatcaaaattattcattttacgcttaattttattggttgaactaatagatagatagataaagatatagagttaatataaaaatgangaaaata

SEQ ID NO: 670 - DNA, 473 bp, Ctenocephalides felis
  misc_feature (75)..(75): n = unknown
cttttatccgtaagtaataaaatgtggcaaaaggttctaatttatttactgccccttgtggcatccatatattgnaacggcgaactgagtgtattaaattctccaaatggagtccaattccaaggcgagactcctttaccccaatctttgttaaaggaattgtattccgtagccttaggattgacatcggagcagagttctgctgaatgggacggagtgagtaaattgaatccttttcaattacctaaagctgtagtcactgtagttgtagaaggcactgataaacttagtttggattcgaagaatacatatcctttggttgtggatgaggaattggataatacttgggactctttggataaacgctttaaagaacgctacccctttgatgatttgactctcgtgaacctggaattacctaatggtaacgtcaattctgagcgtgtctttggtgttgtatcacccaaaccggt

SEQ ID NO: 671 - DNA, 543 bp, Ctenocephalides felis
  misc_feature (28)..(28): n = unknown
  misc_feature (75)..(77): n = unknown
  misc_feature (135)..(135): n = unknown
  misc_feature (213)..(213): n = unknown
  misc_feature (278)..(278): n = unknown
  misc_feature (334)..(334): n = unknown
  misc_feature (394)..(394): n = unknown
  misc_feature (410)..(410): n = unknown
  misc_feature (413)..(413): n = unknown
  misc_feature (501)..(501): n = unknown
  misc_feature (529)..(529): n = unknown
tttttttttttttttttttttgaacggnccaaacgatttatttttattaaaaagatacatgtaatttcataaagnnnctatatttatatattttaaataatcagaaattactatagttaatgacattttgtttgngctccttacataaaatacaattttatacattttaatttttatacatattttttatatttaattgcacagatcatttgngtatttattatattaattgactactttatgacaatttgaatcctaattagtctattcaagattgntttcctggtttaagccttacttagcaatctcacttttgcattcttcgccgggtggngtgggtatgcatcgcaactccgttttatcaaagtgcaagccatttggacaatcataatgntttatttgccatttgntgntaaccaagaaacattgataatattttttacaatctcttcgatcggaaaaaacgttttcacttttgcatgcagtctgcccgagaaagantttgggtcaaaccattcgttggcgtcgncttcacatttcagt

SEQ ID NO: 672 - DNA, 240 bp, Ctenocephalides felis
  misc_feature (19)..(19): n = unknown
  misc_feature (60)..(62): n = unknown
  misc_feature (71)..(71): n = unknown
  misc_feature (167)..(167): n = unknown
  misc_feature (232)..(232): n = unknown
ttttttttttttttttaanttcataaagcttctatatttatatattttaaataatcagannntactagggntaatgacattttgtttgtgctccttacataaaatacaattttatacattttaatttttatacatattttttatatttaattgcacagatcatttgngtatttattatattaattgactactttatgataatttgaatcctaattagtctattcaagattgntttcctgg

SEQ ID NO: 673 - DNA, 210 bp, Ctenocephalides felis
cggaagcaccttagctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcacttatatttggataaaatctcgatggtgacggacatttgaaaccttgt

SEQ ID NO: 674 - DNA, 402 bp, Ctenocephalides felis
  misc_feature (39)..(39): n = unknown
  misc_feature (63)..(63): n = unknown
  misc_feature (138)..(138): n = unknown
  misc_feature (194)..(194): n = unknown
  misc_feature (396)..(396): n = unknown
tttttttttttttttttttttttcgacaattttacttgnatttatcttaaacatatttacagnatttcctcaaaaactgttaaatacaataagttaacttaaatacatggatgttctgagaatgtggatgagctcaanattgtagaactgagtttgatctacacaatttttgcctaaaaggttcgactactcanaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatcatattcataaatatacatatattttaatacaaaaaggnagcttg

SEQ ID NO: 675 - DNA, 272 bp, Ctenocephalides felis
  misc_feature (16)..(16): n = unknown
  misc_feature (20)..(21): n = unknown
taaaataggggccaangggnncggatataaaattttattaaaatacacaaacataacaaatgtcgttaattactaattcaaagtttcatacgatatgtcatatgctaattttagatttattatcataaataaatttattatttaaatcatattagaggaaaaaaaaatattttctcaattctctccttcaaaacttctttgcacttctccggctccatacagttttaataccacttttttcacaaaattcaacatttttgtaaaatccattg

SEQ ID NO: 676 - DNA, 455 bp, Ctenocephalides felis
  misc_feature (36)..(36): n = unknown
  misc_feature (60)..(60): n = unknown
cgttttatccgtaagtaataaaatgtggcaaaaggntctaatttatttactgccccttgnggcatccatatattgcaacggcgaactgagtgtattaaattctccaaatggagtccaattccaaggcgagactcctttaccccaatctttgttaaaggaattgtattccgtagccttaggattgacatcggagcagagttctgctgaatgggacggagtgagtaaattgaatccttttcaattacctaaagctgtagtcactgtagttgtagaaggcactgataaacttagtttggattcgaagaatacatatcctttggttgtggatgaggaattggataatacttgggactctttggataaacgctttaaagaacgctacccctttgatgatttgactctcgtgaacctggaattacctaatggtaacgtcaattctgagcgtgtctttggtg

SEQ ID NO: 677 - DNA, 476 bp, Ctenocephalides felis
  misc_feature (411)..(411): n = unknown
gaagacgacgtcacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgncattaactatagtaatttctgattatttaaaatatataaatatagaagctttatgaaaaaaaaaa

SEQ ID NO: 678 - DNA, 399 bp, Ctenocephalides felis
  misc_feature (66)..(66): n = unknown
  misc_feature (92)..(92): n = unknown
  misc_feature (134)..(134): n = unknown
  misc_feature (142)..(142): n = unknown
  misc_feature (176)..(176): n = unknown
  misc_feature (233)..(233): n = unknown
  misc_feature (309)..(309): n = unknown
  misc_feature (343)..(343): n = unknown
  misc_feature (353)..(353): n = unknown
  misc_feature (377)..(377): n = unknown
  misc_feature (384)..(384): n = unknown
ttttttttttttttttttttttagggtccaggtaaatttatataaataaaaacttaataaaaatgntaattcatataaatcttaatcatggntatttattaatttgattgattttattaaaacaagcatactgntacaatgnatgtctatgaaaaacccaattgattgacaactgncaattaaacatctctggaagaacaaaaaatattccagagagaacttaaaaaccttgnattcttgatcaatatattcataaacaatgcttgaagtggcaggattttaatagacaatacatcaactaggattatnaacgacacaactttgtcaaacttgtttaaacagnttgaattggntctcatagtattttaattttgaanggggtgnaaaaacattatttat

SEQ ID NO: 679 - DNA, 373 bp, Ctenocephalides felis
  misc_feature (346)..(346): n = unknown
  misc_feature (357)..(357): n = unknown
  misc_feature (362)..(363): n = unknown
tgtcaagtccaatccaaaagtggaagctttttcaggaaagttactagagaggtgtcatttccaccagtgggttcaagaaataatcgtacaatcagctgtgtccgtgccctagaccaatatgtaaatggccaaggaggctatgccactcttgtcaatggtggagttggctggaaaaatgtaactttactcttatcttctcagactggcaaaggatttaacttcttagttgaaatttggggatattagattagagatttaataaaaatgttattatagaaaatatattaaatatacaatagtattttaaatatggcacacatctatctatgcatccataaataaaggntatctactgcnttccnnaaaaaaaaaa

SEQ ID NO: 680 - DNA, 130 bp, Ctenocephalides felis
  misc_feature (65)..(65): n = unknown
cttttgcatgtaggaccaatggatcgcgaaatagtccaactcttggacaaatgaatggttgctgncaaatacgaacgctgctggaatttgtttcaactggaattagttcttgagactccaaagacaatgt

SEQ ID NO: 681 - DNA, 448 bp, Ctenocephalides felis
cccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattta

SEQ ID NO: 682 - DNA, 276 bp, Ctenocephalides felis
catataaattgttgaagaaaagttgtttatttgtatttatttgtaaatattgttaaagttaaatatataaagattggttttatgggttatatgtctaacatttattttgtaacatacagttaagaacacaatagaaaaatcatttaattagttggatatttttagtataagtattcctgtgtagatagcaagttgtgactacagaataaatatctgattttatcacaaggtaaaaaaaaaaaaaaaaaaaaaaaaaaaaaaaaaaaaaaaaaaaaa

SEQ ID NO: 683 - DNA, 348 bp, Ctenocephalides felis
  misc_feature (62)..(63): n = unknown
  misc_feature (76)..(76): n = unknown
  misc_feature (87)..(87): n = unknown
  misc_feature (110)..(110): n = unknown
  misc_feature (165)..(165): n = unknown
  misc_feature (176)..(176): n = unknown
  misc_feature (181)..(181): n = unknown
cccgacaggcccaaatctcgatagttacgcgactcataaataattttttaaacattgaatgnnaaaaaaaattaangggggcaaagntaatatatgtattggattaactnagttaattctccctcgcaattttatactatagtaaccagaaacaaaaatcagagngtgtaaaatgnaaatncatatatttttggtaaaaatacaatcaagatataacagtgccacaatattattaaaatacgtatttgtgacgaaacctaaagtgtagtcagaatataaaaaacaataatatttataccttcaaatgtatgctttgaaaaaaagcattcgaagattatgtttaaatat

SEQ ID NO: 684 - DNA, 255 bp, Ctenocephalides felis
cggcgacaaaacacttgaagataaattctttgaacatgaggttcatctcaatgtgtttgctttcttgcaacaattccatttcggagtattttactcttatttgaaactcaaggaacaagagtgccgtaacattgtttggataagtgagtgcgttgctcaaaagcacaggaccaagattgacaactacattccaatattttaattaatttgttgttaattttgataacgttgattttatccagatgtttgttgtgt

SEQ ID NO: 685 - DNA, 378 bp, Ctenocephalides felis
cgtcaagtccaatccaagagtggaaactttttcaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaagatgtgaatatagaaaaaaaattaaatatacaatagtattttaaatttggcacacatctatctatgcatccataaataaaggttatatacagcattcaaaaaaaaaaaaaaaaaa

SEQ ID NO: 686 - DNA, 500 bp, Ctenocephalides felis
  misc_feature (59)..(59): n = unknown
  misc_feature (63)..(63): n = unknown
  misc_feature (141)..(141): n = unknown
  misc_feature (219)..(219): n = unknown
  misc_feature (374)..(374): n = unknown
ttttttttttttttttttttttttttttcacggcccaaacgatttatttttattaaaangatncatgtaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagngcaagccatttggacaatcataatgttttatttgccatttgttgttaaccaagaaacattgataatattttttacaatctcttcgatcggaaaaaacgttttcacttttgcatgcaagtctgcacg

SEQ ID NO: 687 - DNA, 114 bp, Ctenocephalides felis
agcattgtataactctgcaggggtggcagctacatgaatagcctccatttgttcgaaacttccaagtgggtggcatttgggaatcaattcagaaattggtctctgatgtagtgt

SEQ ID NO: 688 - DNA, 221 bp, Ctenocephalides felis
  misc_feature (34)..(34): n = unknown
tatataatctgattctcgatttgtatcttcatanctgattctcagatatccattaccggaatgttcatcattacgtctgagttgtccactaaattcaactttttttccattttcttccatgacatgtctgaattttattttaccatcaactaaagattccatgtgagctcttgcgcaagttccatctcgttcaaaatgattttggtatctatattgttcgt

SEQ ID NO: 689 - DNA, 103 bp, Ctenocephalides felis
gacttcttcaattgggcctaccatatagaaagctacttcaggaagatgatcgtattcacctgcaagaatcttggtgaagcccttgatggtttcttctaatggt

SEQ ID NO: 690 - DNA, 411 bp, Ctenocephalides felis
tttttttttaaacttcataaaatcattataattcttaaacaattataaatgaatgctgtatataacctttatttatggatgcatagatagatgtgtgccaaatttaaaatactattgtatatttaattttttttctatattcacattttcattatatttctaatctaatatccccaaatttcaactaagaagttaaatcctttgccagtctgagaagataggagtaaagttacatttttccagccaactccaccattgacaagagtggcatagcctccttggccatttacatattggtccagggcacgaacacagctaattgtgcgattatttctcgatcccactggtggaaatgacacctctctagtagctttcctgaaaaagtttccactcttggattggacttgacgg

SEQ ID NO: 691 - DNA, 498 bp, Ctenocephalides felis
tgaaatgtgaagacgacgtcaacgaatggtttgacccaaaatctttctcgtgcagaactgcatgcagaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgtatctttttaata

SEQ ID NO: 692 - DNA, 395 bp, Ctenocephalides felis
ttagcccaagtttcacagcaggtttggcagtcactataatagtatactccctttcattttctcctgaaccaactttgcatgtgtaagagccagcatcatcttgttcagttttttcaataatgaattgatgttcttcctttattaattggtaacggtccttgagatcattgatttcttctacttttttctcatctttaaaccactgatcaacaggaccatctttcaatggacaggttagaaccaatggactacgaatatcaaaaagtttttgcgacgtggcttcaccttctctggcataaacactgctttggaccaaaaataataaaattgcactacacaaaaactgcttcatatttattgaattttcttcccctcgattgaaatagttcataagt

SEQ ID NO: 693 - DNA, 499 bp, Ctenocephalides felis
  misc_feature (68)..(68): n = unknown
ctgaaatgtgaagacgacgtcaacgaatggtttgtcccaaaatctttctcgtgcagaactgcatgcgnaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttattgaaattacatgttctttttaat

SEQ ID NO: 694 - DNA, 498 bp, Ctenocephalides felis
  misc_feature (65)..(65): n = unknown
cctagtgagtgtgttatatgaaattgctattgcatattacatacaagcttaataaaggttatggngatttatttgcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgttttaagtataaatcttattagggcacaatatgaaaataaaaataagaactttatcaaaagctttttttatcaatatgcttcttgcgctattaagttaagaaattttatttatgcttgtaaaaaacaaataaatgctttattattcga

SEQ ID NO: 695 - DNA, 498 bp, Ctenocephalides felis
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcaacaaagctgaaatggaggagagtgatacagatcaaagtccagatcgaaaaaatactcctgatcacatgaaggacactgatgtgaggcataggaagtaaaccaaaaatttaatctagttgaataaaagttaatgcaccagagtaggaag

SEQ ID NO: 696 - DNA, 153 bp, Ctenocephalides felis
tttacctttgtacgtaggggcacaaattccacgaagtttttgtcatagaagtcatccaaagcacgcatatatttactgtatgaaatcaaccaattgattgaagggaaatgtttcctttgagctaatttcttatccaaaccccagaacacttgt

SEQ ID NO: 697 - DNA, 204 bp, Ctenocephalides felis
cagttaatgatctacaacttgttcaaaaagccttaactgatggatcgaacgcgtgtggaagttcaatcgaatccttcctaaatgttattgaaactgaagaagcacctccaacctttaatagaactaacaaattcactcaaggtttccaaaacttgatagatgcctacggagttgctagttacagagaagtaaatccagctctgt

SEQ ID NO: 698 - DNA, 399 bp, Ctenocephalides felis
  misc_feature (373)..(374): n = unknown
caaatatctagcatgccaacattcgtgttcctgaaaaacggaaccaccgtaaccacgttcactggtgcgaactacgacaaagttcgggaaaccattacttctaatttataaatctttatgctgagtgcctgctatagatgtttaggcttagatttcaaaattttaatgtttcagaaaattgttcatgtttgcacaaattatatgtatatattttttcttaacttcaaatcctaaaattacttcattgtgctattttattcattaagcgtattctacatagatcacatagtgtctttatcagtgagcagttcatagtatatttaagctaatatattttttgttactgtatgagttcataaaggttataacatannaaaaaaaaaaaaaaaaaaaaaaaaa

SEQ ID NO: 699 - DNA, 487 bp, Ctenocephalides felis
atattatattcacaataatctaatcttccaagttgcggaatgcttgctgtaaatcctcatgtaattgatcaaaatcactcttgatctttgcctcaccatccttgactgggtccttgaacttcattgaggacaactgatatagaatattgcccatagcatctctaatggtattccaggtaatcttgttttcactttgtgcagtagattcaactgcgtattttgccatatcatagaaagcaataatgttacgtaacataccaactgttttatagaaggggcagaaacgatcatatgatgagtagctgttctgctgtaggaaatcgtctttcaagagcttggcaacttcaagtgtgatcttgtcagtttccgccaaggaggctttaccaaccaattgtacaatttctgataaatcttcttcttcttgcaaaatttcctttacctttgtacgtaggggcacaaattccacgaagttttgcatagaagtcat

SEQ ID NO: 700 - DNA, 393 bp, Ctenocephalides felis
  misc_feature (346)..(346): n = unknown
ttagcccaagtttcacagcaggtttggcagtcactataatagtatactccctttcattttctcctgaaccaactttgcatgtgtaagagccagcatcatcttgttcagttttttcaataatgaattgatgttcttcctttattaattggtaacggtccttgagatcattgatttcttctacttttttctcatctttaaaccactgatcaacaggaccatctttcaatggacaggttagaaccaatggactacgaatatcaaaaagtttttgcgacgtggcttcaccttctctggcataaacactgctttggaccaaaaataataaaattgcctacacaaaaactgnttcatatttattggaatttctttccctcgattgaaatagttcataag

SEQ ID NO: 701 - DNA, 452 bp, Ctenocephalides felis
aacaaaaagataatatattctaaatatagtttcaatcaatgatattttctaaattgaggataattaggctatattatgtcggtaattcattttatatatatagaaactcatgtgcacccaaatccggtctggcttcatcataaaatgaaattcaaaatactgttacaattggtttggcccgagataaatactttgtacacaacaaacatctggataaaatcaacgttatcaaaattaacaacaaattaattaaaatattggaatgtagttgtcaatcttggtcctgtgcttttgagcaacgcactcacttatccaaacaatgttacggcactcttgttccttgagtttcaaataagagtaaaatactccgaaatggaattgttgcaagaaagcaaacacattgagatgaacctcatgttcaaagaatttatcttcaagtgttttgtcgccgg

SEQ ID NO: 702 - DNA, 343 bp, Ctenocephalides felis
  misc_feature (84)..(84): n = unknown
  misc_feature (121)..(121): n = unknown
  misc_feature (244)..(244): n = unknown
ttttcatgtcgatgttttagaaaatgattcagtagcaacttctgaattttctttgtaatcgataatactttctcaaagtataantgcatttcacaacacacgacggaaatatggttatggnccatatgaagcaatgctcgttcttctatccacttgcttctgataaatgttcggtataaagaatgcaatcactccacatgctatcagagatgttcctgatattaaaaatgttaaatcgcaattntaatctagaattattcctacaacattgctttcaacaacacttcctaatcgacccatcattaaagatatacatactgccattgccctgagttgggtaggg

SEQ ID NO: 703 - DNA, 386 bp, Ctenocephalides felis
  misc_feature (215)..(215): n = unknown
  misc_feature (360)..(360): n = unknown
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttnatatggaccataaccatatttccgtcgtgtgttgtgaaatgcaattatactttgagaaagtattatcaattacaaagaaaattcagaagttgctactgaatcattttctaaaacatcgacatgaaaattaataactctttattgntattagattcgatgtaagatatatgt

SEQ ID NO: 704 - DNA, 492 bp, Ctenocephalides felis
  misc_feature (312)..(312): n = unknown
  misc_feature (332)..(332): n = unknown
  misc_feature (386)..(386): n = unknown
  misc_feature (438)..(438): n = unknown
  misc_feature (441)..(441): n = unknown
  misc_feature (449)..(449): n = unknown
  misc_feature (457)..(457): n = unknown
tgaaatgtggaagaccgacgtcaaccgaatgggtttgtcccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtngtcaattaatataataaatncacaaatgatctgtgcaattaaatataaaaaatatgtataaaaattaaaatggnataaaattgtattttatgtaaggagcacaaacaaaaatggcatttaactttngtnatttctgntttatttnaaaatattataaattttggaagctttatggaaatt

SEQ ID NO: 705 - DNA, 323 bp, Ctenocephalides felis
  misc_feature (7)..(7): n = unknown
  misc_feature (48)..(48): n = unknown
  misc_feature (90)..(90): n = unknown
  misc_feature (136)..(136): n = unknown
  misc_feature (193)..(193): n = unknown
  misc_feature (270)..(270): n = unknown
  misc_feature (314)..(314): n = unknown
aactgcntgcaaaagtgaaaacgttttttccgatcgaagaggattgtnaaaaatattatcaatgtttcttggttaacaacaaatggcaanttaaacattatgattgtccaaatggcttgcactttgataaaacggngttgcgatgcatacccacgccacccggcgaagaatgcaaaagtgagattgctaagtnaggcttaaaccaggaaaacaatcttgaatagactaattaggattcaaattatcataaagtaggcaattaatataatnaatacacaaatgatctgtgcaattaaatataaaaaatatgtatnaaaattaaa

SEQ ID NO: 706 - skipped

SEQ ID NO: 707 - DNA, 334 bp, Ctenocephalides felis
  misc_feature (5)..(5): n = unknown
  misc_feature (41)..(41): n = unknown
  misc_feature (47)..(47): n = unknown
  misc_feature (62)..(62): n = unknown
  misc_feature (95)..(95): n = unknown
  misc_feature (100)..(101): n = unknown
aaccnaaattttctaacattcacaaaattgcacgtcaaaancgaacntttattttcaaacanttaataaattaacaacgggcttagcaattatanatatnncagctcactactacaaattacatatttttatcaatcatatatatatatatatagtttttggtttaagatatataacaacaatgtttctatcgcacatatcattaaatatactttcatatgcgacaagacaagtttttgcattaaaaaaatatatgttactaatgacaatatttagaatcacacttgaagactcctcctcggagccttcggggggcgcgagttaaacaacaatg

SEQ ID NO: 708 - DNA, 415 bp, Ctenocephalides felis
  misc_feature (15)..(15): n = unknown
  misc_feature (41)..(41): n = unknown
  misc_feature (82)..(82): n = unknown
  misc_feature (104)..(104): n = unknown
  misc_feature (211)..(211): n = unknown
  misc_feature (235)..(235): n = unknown
  misc_feature (272)..(272): n = unknown
  misc_feature (387)..(387): n = unknown
agtgagatatcagcnatagtttatgattttattgacgttgngaacggacatgtggtctgatagtttataaatttgccgtatngaaacaataataaattacagtncataatactgatttgattttactacccgtaaccgattctgcttcagatatttccagaaaaatgttagttttcatacattttatttaatttaatatctcccgacttgntattactaagcgaaattttctctnttttaaatatagaattctttatagtattcataatagncgaagctttaaagtatttcttctcactatcacccttttttatacaaacgcattttgagaagtaacgtgaaagcttactttcgaattggtgatgtttctatgaatactttatatgnattataatatgtattaaattgaattttt

SEQ ID NO: 709 - DNA, 401 bp, Ctenocephalides felis
  misc_feature (40)..(40): n = unknown
  misc_feature (157)..(157): n = unknown
  misc_feature (393)..(393): n = unknown
atattcacaataatctaatcttccaagttgcggaatgctngctgtaaatcctcatgtaattgatcaaaatcactcttgatctttgcctcaccatccttgactgggtccttgaacttcattgaggacaactgatatagaatattgcccatagcatctntaatggtattccaggtaatcttgttttcactttgtgcagtagattcaactgcgtattttgccatatcatagaaagcaataatgttaccgtaacataccaactgttttatagaaggggcagaaacgatcatatgatgagtagctgttctgctgtaggaaatcgtctttcaagagcttggcaacttcaagtgtgatcttgtcagttttcgccaaggaggcttttaccaaccaattgtncaaatttt

SEQ ID NO: 710 - DNA, 168 bp, Ctenocephalides felis
  misc_feature (4)..(4): n = unknown
actntatttcttcattgccaaatgttgttcgtgctctggatcttcccactgggaaaccgcggacatatgtgggcgaattcctgtcagcagccacagcacccaaggcaaacactgcaaccaataaagcttctaagaacttcattgtgaaaacttattcctaagtaaaat

SEQ ID NO: 711 - DNA, 461 bp, Ctenocephalides felis
  misc_feature (75)..(75): n = unknown
  misc_feature (245)..(245): n = unknown
  misc_feature (294)..(294): n = unknown
  misc_feature (357)..(357): n = unknown
ttttttttttttttccggtccatacaactctaagctttccaacatttggattttattcaaataaatataaataanaaatcataattcgacaattttactcgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggntcgactactcagaaagcagccacccgtgattccataccgcctcacattngacaataaaatatatgtataatgttaaataggattttaatggaaaaaagccaatttaatactntagcattatgaatatgtatttccaaattattctataacgaatttaacctaaaataccaagggaatacatattcataaatatacatatatttttaataccaaaag

SEQ ID NO: 712 - DNA, 367 bp, Ctenocephalides canis
  misc_feature (352)..(352): n = unknown
  misc_feature (358)..(358): n = unknown
cgtcaagtccaatccaagagtggaaacttttttaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatncagaanaaaaaaaaa

SEQ ID NO: 713 - DNA, 448 bp, Ctenocephalides canis
acaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatcaattttataaagctgtttggataaattaatttgaataaatcataatcatagaatatgttaaggtagccaaataaaatatggcccacaaaccccaaaaatggtt

SEQ ID NO: 714 - DNA, 168 bp, Ctenocephalides canis
  misc_feature (59)..(59): n = unknown
  misc_feature (110)..(110): n = unknown
ctgcataccagtcagactgtttaggtgcaagtgtcacttcttccccatccataccatgncttaccatccttaccatcttttccaaccttgccaacatcttccccaacagnaggatttccttttggccgaaaatctcttgatatgcaaacaaaaactggagctaaatgt

SEQ ID NO: 715 - DNA, 428 bp, Ctenocephalides canis
gtattcaatggtatgaattgcttggtgaatgaaaatttcactcatgggttcttcttcgtgttctccatgagctgcttttggcggtgcctttggtgcctctggcataccgttttcttggctggagacaacgtctgaagtcatttccattccttggttcaaatcaccatttgatttagcagaatgaggagcttcatctttatttttcttggttgccatcaaatataatggtttgcccaagagcatgagcggaatacagcagagcccaattaacacaaatattttttgaatttgctgttgtccttcaaacataaattcatcgcaatgttctgctggagatccttgcttgaataacatcatgttaatgaacagaatcaaaactgatggtgcgcagcaagggttcaaatctgatgtctgtattatttgcagag

SEQ ID NO: 716 - DNA, 498 bp, Ctenocephalides canis
  misc_feature (471)..(471): n = unknown
  misc_feature (478)..(478): n = unknown
tatcttttgctaccaatgctcaaaggcgataatggacccacagcctggcgtccaaaatgcttcctcgtccgcaacgacatagtcgttttgcaagatttatccatgtataattttcgccattcgtacccaaaattctctttggatcttgatcatgttaaagttgctttaacggcattggctcgtatgcatgcaagttgcattatctacgagaagaaaaaaaattgttgcatggggagagtttacaaagatcttatgttcgagactatggccaataataatcaatggtggaggactggagaggatactgctttagcaattgctgaggaatctgagaaattcggtaaatataccgaatccattccatggtacaggagaagttaattgatttcctgagattggcatggtctatggtaaaaccatcgcgcatttataaaaatgtggtatgcccccgcgatcgcgcaatccaaattngtggtcnaatttaattcaactgggcta

SEQ ID NO: 717 - DNA, 348 bp, Ctenocephalides canis
  misc_feature (141)..(141): n = unknown
gcaaaaatattaatgcacttatgtcaatattttaatatagtattgccaggaaaagctaagtattaagtataatatatttagttattcttaaacatcagttgttttgataaagctgtatcttaaaaggactttatatacagnaattatcttcagaaatcctttccacaattttgctcggtgtgttttaagtttgtcaacatctatgggtgtattatttttcacatatgtccaaatttctttcattaattccgacgatgggttttgctcacgtgtgagaatcccaagctaattctatttttcctcgaggatgaatagtgcagcttccttacaacagcaaatttatcaaaa

SEQ ID NO: 718 - DNA, 209 bp, Ctenocephalides canis
  misc_feature (95)..(95): n = unknown
  misc_feature (108)..(108): n = unknown
  misc_feature (153)..(153): n = unknown
  misc_feature (183)..(183): n = unknown
atataaatatgatgctattgttaaatgttcaataaatgcacaaattattccacaaatcccgcatgagaccattacgaatacaagaattggaagcnttcccacagagtnaataatagcacctattatgggaaatccaatcgcatatccagcttncaacattaaagaatgcataaatgcctgttnttccattgtgtctttacactcggccg

SEQ ID NO: 719 - DNA, 500 bp, Ctenocephalides canis
gataaattttatttaaaacttgcaaaaattatttaaacaatttacgcatagcacatttcgctcgtgcaaatctcttcctcgcattccagacaagtttccttatcgcatttgtaggtgtcggtgcagcctctcttcactttatctccgtcaatatctaagtagcatttgcccatgcatttggtcttcgtctcgactttttcagggtccgtcaaggcaattttcatcattttcatcacaagaaacacattcgtgttttttggcatcaccattgcattcgtttttgtcacaagttgggcaacgttctggttttttctcgcacatttttttcagattctggttcttgaacaggttgctggtgcaccctaattttatggcatcaccttgtgcatttaaaatactcaaacaagtatcttgtggcttgagacaaacttccttggcatcatctttagcgttgcaaaccctgcgatttctttggggaaaaacatcgacattaccaaagg

SEQ ID NO: 720 - DNA, 459 bp, Ctenocephalides canis
  misc_feature (166)..(166): n = unknown
  misc_feature (183)..(183): n = unknown
  misc_feature (261)..(261): n = unknown
  misc_feature (311)..(311): n = unknown
  misc_feature (367)..(367): n = unknown
aaatctcttcttcgcattccagacaagtttccttgtcgcatttgtaggtgtcagtgcatcctctcttcactttatctccgtcaatgtgtaagtagcatctgcgcatacacttggtcttcgtctcgactttttcaggatcgtccaggcaattttcatcattttcatngcaggaaacacattcgntgttttttagcatcaccattgcattcattttggtcacaagttgggcaacgttctggttttttctcgcacatttttttnagattttggttcttgaacaggttgctggtgcagcctaatttgatggcatnaccttgtgcattcagaatactcaaacaagtatctttaggattgagacaaactttcnttggcatcatcttttagcattgcaaaacccctgcgatttcttgggaaaaacatcgatattacaaaaggtacctttgcacttcttggcatttt

SEQ ID NO: 721 - DNA, 427 bp, Ctenocephalides canis
  misc_feature (16)..(16): n = unknown
  misc_feature (86)..(86): n = unknown
  misc_feature (99)..(99): n = unknown
  misc_feature (209)..(209): n = unknown
  misc_feature (223)..(223): n = unknown
  misc_feature (256)..(256): n = unknown
  misc_feature (317)..(317): n = unknown
  misc_feature (326)..(326): n = unknown
  misc_feature (356)..(356): n = unknown
  misc_feature (401)..(402): n = unknown
  misc_feature (420)..(420): n = unknown
ataatcaatcaaggangttcacaatatataaaaaaaacttggataaatgtgataaacataaaatttgtttctaatgatttttgctntacagaaaatttnatcaaaataattcatatacaatattatgtaaaattaaaatatgtaagttaatacaatttagaatgatatcagtatgacaaattgtggaaatatttacctttacaaaagtnaaaacaaaaatttnggaaataggaaaaataataagaaattattttanaataattttgccttatacttatgaattttaaaagaatatttttcctactaaaataccttancaattaccnaaaatcattaccccttggaatataaaaaantctaatcttggaataaaagggttagggtattttaaaacaaattcnnatttttttttattttcanagggcga

SEQ ID NO: 722 - DNA, 473 bp, Ctenocephalides canis
  misc_feature (32)..(32): n = unknown
  misc_feature (36)..(36): n = unknown
  misc_feature (390)..(390): n = unknown
  misc_feature (432)..(432): n = unknown
gatgaaatcaagaaattgttgtaaattaagcnattnacaaccataacaaaaaaagagaaaaatctaaaaacaatttaaattagcaaaaccaagtgtatttgaatttcatttttgcacaagctacctttttgtattaaaatatatgtatatttatgaatatgtatttcttgtattttaggttaaattcgttatagaataatttggaaatacatattcataatgctaaagtattaaattggcttttttccattaaaatcctatttaacattatacatatattttattgtcaaatgtgaggcggtatggaatcacgggtggctgctttctgagtagtcgaaccttttaggcaaaaattgtgtagatcaaactcagttctacaatcttgagctnatccacattctcagaacatccatgtatttaagttaacttatnggatttaacaggtttttgggggaaatactgcaaatatgttt

SEQ ID NO: 723 - DNA, 204 bp, Ctenocephalides canis; identical to SEQ ID NO: 697

SEQ ID NO: 724 - DNA, 439 bp, Ctenocephalides felis
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcacaaagctgaaatggaggagagtgatacagatcaaagtccagatcgaaaaaatactcctgatcacatgaaggacactgatgtgaggcata

SEQ ID NO: 725 - DNA, 406 bp, Ctenocephalides felis
  misc_feature (46)..(46): n = unknown
  misc_feature (50)..(50): n = unknown
  misc_feature (52)..(52): n = unknown
  misc_feature (79)..(79): n = unknown
  misc_feature (88)..(88): n = unknown
  misc_feature (155)..(155): n = unknown
  misc_feature (161)..(162): n = unknown
  misc_feature (176)..(176): n = unknown
  misc_feature (182)..(183): n = unknown
  misc_feature (190)..(190): n = unknown
  misc_feature (208)..(208): n = unknown
  misc_feature (243)..(243): n = unknown
  misc_feature (246)..(246): n = unknown
  misc_feature (258)..(258): n = unknown
  misc_feature (293)..(293): n = unknown
  misc_feature (302)..(302): n = unknown
  misc_feature (309)..(309): n = unknown
  misc_feature (313)..(313): n = unknown
  misc_feature (326)..(326): n = unknown
  misc_feature (364)..(365): n = unknown
ggacaaccattcgaaattccaaaaggaaatttactattgaatgatnaaangnaatagattaatcaaattttagatgatnaaaattgtnctattactacaatagcaacctctgcctgaaaattaaccgaacaaacttctaacatccttattaatgnatagannttgaataataacanagaaannatactanttttttgatgactctaanaaaaaaaatgtataaatggccatgcctgatatatnttngataaccttaangaaaaaatgtttaaatggccatgtctgaaaagatntctatgggnatttttntggnaacattctattgntgaatggataaaagataaatacaattttataagctggnntggataaattaattttgaataaaatccaaaatcatagaata

SEQ ID NO: 726 - DNA, 131 bp, Ctenocephalides felis; identical to SEQ ID NO: 515

SEQ ID NO: 727 - DNA, 167 bp, Ctenocephalides felis
ctgcataccagtcagactgtttaggtgcaagtgtcacttcttccccatccataccatccttaccatccttaccatctttcccaaccttgccaacatcttccccaacagcaggacttccctttggccgaaaatctcttgatatgcaaacaaaaactggaactaaatgt

SEQ ID NO: 728 - DNA, 386 bp, Ctenocephalides felis; identical to SEQ ID NO: 468

SEQ ID NO: 729 - DNA, 436 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaaggagcacaaacaaaatgtcattaactatagtaa

SEQ ID NO: 730 - DNA, 447 bp, Ctenocephalides felis
  misc_feature (34)..(34): n = unknown
tgaaatgtgaagacgacgtcaacgaatggtttgncccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaaatttgtttttatgtaaggagcacaaacaaaaatggtcattaacctattagtaaatttctg

SEQ ID NO: 731 - DNA, 422 bp, Ctenocephalides felis
  misc_feature (378)..(378): n = unknown
taacctctaatgacgtcttaacacgtaagacaaggcaagcagatgatgctccaaaagaacccgatttcaacctagctaaagaatacaacgactcctacccggtggtttttaacatcattttatggttcggagtagcctttttcttctcgttacttgctatctgtatctcgatctccacaatggaccctggcagggactccattatttacagaatgacatccacacgcatcaagaaggagaattaaagtttgcgaaaggagtgtttttaattgtaaatagattgtttagtattattacaatgtaaccgagttattaatttgtgatcaatataaattaaaaattaaaatacaatatctttgttgaaaatcgaattattgntctattatattttttgttttacattcctagtattaccgaattgt

SEQ ID NO: 732 - DNA, 396 bp, Ctenocephalides felis
  misc_feature (314)..(314): n = unknown
  misc_feature (350)..(351): n = unknown
tctttctcgtgcagaactgcatgcaaaagtgaaaacgttttttccgatcgaagagattgtaaaaaatattatcaatgtttcttggttaacaacaaatggcaaataaaacattatgattgccaaatggcttgcactttgataaaacggagttgcgatgcatacccacgccacccggccgaagaatgcaaaagtgagattgctaagtaaggcttaaaccaggaaaacaatcttgaatagactaattaggattcaaattatcataaagtagtcaattaatataataaatacacaaatgatctgtgcaattaaatatnaaaaatatgtataaaaattaaaatgtataaaattgnnattttatggtaaggagcacaaaccaaaattggtcatttaactatt

SEQ ID NO: 733 - DNA, 498 bp, Ctenocephalides felis
  misc_feature (47)..(47): n = unknown
  misc_feature (166)..(166): n = unknown
  misc_feature (210)..(210): n = unknown
  misc_feature (277)..(278): n = unknown
  misc_feature (386)..(386): n = unknown
  misc_feature (405)..(405): n = unknown
  misc_feature (424)..(424): n = unknown
  misc_feature (464)..(464): n = unknown
  misc_feature (481)..(481): n = unknown
ctacaacaactcgatatactcataaattattaatttctaatcgattncctgaaaaatttacgttgttattggtgaaagtgcatttattcgttcatttctgataacttaaaaactatttgcggaaaactaaaaatatgtttggagaaaatatagaaaattgaatagnctaaaacattttcctaacataggaagaccctacagcaactcggnatactcaaaaaagtttgttgaaaagttgataaatattcacagcgcttcactgttttgttcttgagtnnaggaaaagtgcatttatttataacttttgaacgggtttatttgattgaaatgaaatattcggcaaattatagaaaattaaataatctacaaatttttcttttaccggnacaggaaaccaacaaaatnttcccttcggctaataccnggtaaacatcacaaaatggtatccgaatcaatattttttntaaaaattggaaaattngcaaaatggataaaatg

SEQ ID NO: 734 - DNA, 304 bp, Ctenocephalides felis; identical to SEQ ID NO: 72

SEQ ID NO: 735 - DNA, 464 bp, Ctenocephalides felis
ccggtttgggtgatacaacaccaaagacacgctcagaattgacgttccattaggtaattccaggttcacgagagtcaaatcatcaaaggggtagcgttctttaaagcgtttatccaaagagtcccaagtattatccaattcctcatccacaaccaaaggatatgtattcttcgaatccaaactaagtttatcagtgccttctacaactacagtgactacagctttaggtaattgaaaaggattcaatttactcactccgtcccattcagcagaactctgtccgatgtcaatcctaaggctacggaatacaattcctttaacaaagattggggtaaaggagtctcgccttggaattggactccatttggagaaattaatacactcagtcgccgtgcatatatggatgccacaaggggcagtaaataaatagaacctttgcccatttattacttacggataaaacg

SEQ ID NO: 736 - DNA, 273 bp, Ctenocephalides felis
  misc_feature (26)..(27): n = unknown
ttggttattggatttattcccggggnntattttacatgaatcaaagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcgcaactttctttaaccgt

SEQ ID NO: 737 - DNA, 411 bp, Ctenocephalides felis
  misc_feature (26)..(26): n = unknown
  misc_feature (29)..(29): n = unknown
  misc_feature (54)..(54): n = unknown
  misc_feature (62)..(62): n = unknown
  misc_feature (81)..(81): n = unknown
  misc_feature (134)..(134): n = unknown
  misc_feature (181)..(181): n = unknown
  misc_feature (240)..(240): n = unknown
  misc_feature (294)..(294): n = unknown
  misc_feature (299)..(299): n = unknown
  misc_feature (355)..(355): n = unknown
ttttttttttttggggatttatttantcnctttataattttggacattggcggnattaacantttttacctatgagtatgnacatatatcttacatcgaatctaataacaataaagagttattaattttcatgncgatgttttagaaaatgattcagtagcaacttctgaattttctttgnaattgataatactttctcaaagtataattgcatttcacaacacacgacggaaatatggntatggccatatgaagcaatgctcggtcttctatccacttgcttctgataaatgnttggnataaagaatgcaatcactccacatgctatcagagatgtcctgatttaaaaatggtnaatcgcaatataatctagaaatatttctacacattggttccaacacacttcctaat

SEQ ID NO: 738 - DNA, 442 bp, Ctenocephalides felis
  misc_feature (8)..(8): n = unknown
  misc_feature (34)..(35): n = unknown
  misc_feature (37)..(37): n = unknown
  misc_feature (45)..(45): n = unknown
  misc_feature (68)..(68): n = unknown
  misc_feature (90)..(90): n = unknown
  misc_feature (93)..(93): n = unknown
  misc_feature (156)..(156): n = unknown
  misc_feature (168)..(168): n = unknown
  misc_feature (233)..(233): n = unknown
  misc_feature (242)..(242): n = unknown
  misc_feature (359)..(359): n = unknown
  misc_feature (366)..(366): n = unknown
  misc_feature (380)..(380): n = unknown
  misc_feature (386)..(386): n = unknown
  misc_feature (389)..(389): n = unknown
  misc_feature (401)..(401): n = unknown
  misc_feature (403)..(403): n = unknown
tttttttntttttttttaggttcataaagcttcnntntttatatnttttaaataatcagaaattactntagttaatgacattttgtttgngcnccttacataaaatacaattttatacattttaatttttatacatattttttatatttaattgcncagatcatttgngtatttattatattaattgactactttatgataatttgaatcctaattagtctattcaagattgntttcctggnttaagccttacttagcaatctcacttttgcattcttcgccgggtggcgtgggtatgcatcgcaactccgttttatcaaagtgcaagccatttggacaatcataatggttatttgccntttggtngtaacccaaaaacnatgggnaantttttttacaantnttcgacggaaaaaacgttttccttttgcatgccgtttgc

SEQ ID NO: 739 - DNA, 232 bp, Ctenocephalides felis; identical to SEQ ID NO: 73

SEQ ID NO: 740 - DNA, 396 bp, Ctenocephalides felis
actttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggcaacgacagataacgccacaaaactaataaaaaccaatgtgatataaaacattctaataaatatgttacccacacttgggcgggacccaccctaagccgaatt

SEQ ID NO: 741 - DNA, 331 bp, Ctenocephalides felis
catggaatagtgctaaccaaagcaaagataaaccaatctcgcgtcgcccacatcagtggcggcataagaatcattccactggtccacccgatggactgcatcatggcaatgtgtgctctatcttcacttctggatatttccatcgcaattatcaaagggctttgaaaaacagatgtagatgttagtgaaccaagaaaagccgctgttataaaaacaataaaccaactggaagtaaatgctgtaattagtcttccggtgacgattgtgatgagacttaagtaaaatactggtcttcttccaatcctgtctcctaattgaccaaagataaatg

SEQ ID NO: 742 - DNA, 131 bp, Ctenocephalides felis
cttttgcatgtaggatccaatggatcgcgaaatagtccaactcttggacaaatgaatggttgctgccaaatacgaacgctgctggaatttgtttcaactggaattagttcttgagaccccaaagacaatgt

SEQ ID NO: 743 - DNA, 369 bp, Ctenocephalides felis
  misc_feature (23)..(23): n = unknown
  misc_feature (62)..(62): n = unknown
  misc_feature (64)..(64): n = unknown
  misc_feature (96)..(96): n = unknown
  misc_feature (355)..(355): n = unknown
ttttttttttttttttttttttngatttcataaagcttctatatttatatattttaaataancngaaattactatagttaatgacattttgtttgngctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgntttatttgcatttg

SEQ ID NO: 744 - DNA, 285 bp, Ctenocephalides felis
  misc_feature (83)..(83): n = unknown
  misc_feature (117)..(117): n = unknown
  misc_feature (126)..(126): n = unknown
  misc_feature (155)..(155): n = unknown
  misc_feature (173)..(173): n = unknown
  misc_feature (253)..(253): n = unknown
tgaaaaaactttctcaaaggataattgcatttcacaacacaccgacggaaatatgggtatgggccatatgaagcaatgcccgntcttctatccacttgcttctgataaatggtcggnataaagaangcaatcactcccatgctatcaagagatgntcctgatattaaaaatgntaaatccgcaattataatctagaaatattcctacaacattgctttcaacaacacttcctaatcgacccatcattaaaganatacatactggcattgcctgagtggggaaggg

SEQ ID NO: 745 - DNA, 456 bp, Ctenocephalides felis
  misc_feature (22)..(22): n = unknown
  misc_feature (28)..(28): n = unknown
  misc_feature (61)..(61): n = unknown
  misc_feature (74)..(74): n = unknown
  misc_feature (133)..(133): n = unknown
  misc_feature (136)..(136): n = unknown
  misc_feature (422)..(422): n = unknown
  misc_feature (441)..(441): n = unknown
  misc_feature (451)..(451): n = unknown
aacaaaaaagataatatattcntaaatnttttttaacatatcaatggatattttctaaatnggggggataaggnggctatattatgtcgggtaattcattttatatatatagaaactcatgtgcacccaaatncgntctggcttcatcataaaatgaaattcaaaatactgttacaattggtttggcccgagataaatactttgtacacaacaaacatctggataaaatcaacgttatcaaaattaacaacaaattaattaaaatattggaatgtagttgtcaatcttggtcctgtgcttttgagcaacgcactcacttatccaaacaatgttacggcactcttgttccttgagtttcaaataagagtaaaatactccgaatggaattgttgcaagaaagccaacacattgagattgaactnatgtttaaggattatcttnaagtgttttncgccg

SEQ ID NO: 746 - DNA, 469 bp, Ctenocephalides felis
  misc_feature (38)..(38): n = unknown
  misc_feature (44)..(44): n = unknown
  misc_feature (59)..(59): n = unknown
  misc_feature (101)..(101): n = unknown
  misc_feature (376)..(376): n = unknown
  misc_feature (408)..(408): n = unknown
  misc_feature (448)..(448): n = unknown
tcaaaattaacaacaaattaattaaaatatgggaatgnagttgncaatcttggtcctgngcttttgagcaacgcactcacttatccaaacaatgttacggnactcttgttccttgagtttcaaataagagtaaaatactccgaaatggaattgttgcaagaaagcaaacacattgagatgaacctcatgttcaaagaatttatcttcaagtgttttgtcgccggtccatcgccagagccttcgaataaagcagaatactcagcataatattcagctacagctttaacttgtcataatcatcagcacgagccagagcagcttaaccgctggggttagttaccaccaccgggggtcaattaacacgacatccttgctnattcagttccaacgagttgatggtatgatatngcacgttgcagttcaaagctattttcccattgatcactgnggatccccaagtccttgcaaa

SEQ ID NO: 747 - DNA, 210 bp, Ctenocephalides felis
  misc_feature (11)..(11): n = unknown
  misc_feature (64)..(64): n = unknown
ataattaactnccaatataaattatatatagcatgaaaaataattcaattacataaaaatttancaaaaatgtttataaaatctttgcttcattgattattgatcttttacatttaaaaaaaaaatcagtatttattttgaccgttgagacaaaataaacatcgtgagtgaattattttagaagctataatatatattaactaaatatgt

SEQ ID NO: 748 - DNA, 296 bp, Ctenocephalides felis
  misc_feature (21)..(21): n = unknown
  misc_feature (31)..(31): n = unknown
ttttccgaccgattttttcancaataattangggaacaacggacttagcaattataaatattacagctcactactacaaattacatatttttatcaatcatatatatatatatatagttttgggtttaagatatataacaacaatgtttctatcgcacatatcattaaatatactttcatatgcgacaagacaagttttgcattaaaaaaatatatgttactaatgacaatatttagaatcacacttgaagactcctcctcggagcctccggggggcgcgagtaaaacaacaatgt

SEQ ID NO: 749 - DNA, 388 bp, Ctenocephalides felis
  misc_feature (8)..(8): n = unknown
  misc_feature (16)..(16): n = unknown
  misc_feature (36)..(36): n = unknown
  misc_feature (44)..(44): n = unknown
  misc_feature (62)..(62): n = unknown
  misc_feature (158)..(158): n = unknown
  misc_feature (347)..(347): n = unknown
  misc_feature (355)..(355): n = unknown
catggtgngctggatngtttataaaattttggcgtntaggaaancaataataaattacagtncataatactggatttggattttactccgtaacgatttgcttcagatatttccagaaaaatgttagttttcatacattttatttaatttaatatctncgacttgttattactaagcgaaattttctctcttttaaatatagaattctttatagtattcataataggtgaagctttaaagtatttctctcactatcccctttttatacaacgcattttgagaagtaacgtgaaagcttctttcgaattggtgatgttctatgaatacttatatgtattataatatgnattaaatngattttgcgttcaatagacctcaatcataaatt

SEQ ID NO: 750 - DNA, 302 bp, Ctenocephalides felis
  misc_feature (22)..(22): n = unknown
  misc_feature (251)..(251): n = unknown
  misc_feature (253)..(253): n = unknown
ggggatcgagaaaataatcgcncaattagctgtgttcgtgccctggaccaatatgtaaaatggccaaggaggctatgccactcttgtcaatggtgggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttgggncncatctatctatgcatccataaataaaggttatatacagaaaaaaaaaaa

SEQ ID NO: 751 - DNA, 168 bp, Ctenocephalides felis
  misc_feature (5)..(5): n = unknown
  misc_feature (58)..(58): n = unknown
ctgcntaccagtcagactgtttaggtgcaattgtcacttcttccccatccataccatncttaccatccttaccatctttcccaaccttgccaacatcttccccaacagcagggatttccttttggccgaaaatctcttgatatgcaaacaaaaactggagctaaatgt

SEQ ID NO: 752 - DNA, 418 bp, Ctenocephalides felis
  misc_feature (52)..(53): n = unknown
ggtatgaattgtttggtgaatgaaaatttcactcatgggttcttcttcgtgnnctccatgagctgcttttggcggggcctttggtgcctctggcataccgttttcttggctggagacacgtctggaagtcatttccattccttggttcaaatcaccatttgatttagcagaatgaggagcttcatctttatttttcttggttgccatcaaatataatgggtttgcccaagagcatgagccggaatacagcagacccaattaacacaaatattttttgaatttgctgttgccttcaaacataaattcatcgcaatgttctgctgggagatcttgcttgaatacatcatgttaatgaacagaatcaaaactgatgggcgcagcagggttcaaatcttgatgtctgtattatttgcagagt

SEQ ID NO: 753 - DNA, 307 bp, Ctenocephalides felis
  misc_feature (24)..(24): n = unknown
  misc_feature (30)..(30): n = unknown
  misc_feature (36)..(36): n = unknown
  misc_feature (40)..(40): n = unknown
  misc_feature (69)..(69): n = unknown
  misc_feature (74)..(74): n = unknown
  misc_feature (156)..(156): n = unknown
  misc_feature (199)..(199): n = unknown
  misc_feature (299)..(299): n = unknown
cgattttttttacccatattttanaaaggncatatncatngtaggggggcatcgaaaacctgacctttnccatnttggcagaaataagatcttgggcagtctttcggatctggctggatatctacacccgcccatgtagtttctgccgcttacagntttcccaaggttttgatgagcacatatcatctaccaaaatggngcatcggaatttgagtcttctgcaattgatggtgtaattgggggttctttgtccacgcacaacttcaaatagaacaatcgtgacaaaatgttcccactgnttattagt

SEQ ID NO: 754 - DNA, 332 bp, Ctenocephalides felis
  misc_feature (21)..(21): n = unknown
  misc_feature (84)..(84): n = unknown
  misc_feature (172)..(172): n = unknown
  misc_feature (174)..(174): n = unknown
  misc_feature (219)..(219): n = unknown
  misc_feature (290)..(290): n = unknown
  misc_feature (306)..(306): n = unknown
tatgtcaatattttaatatangtattggccaggaaaagctaagtattaagtataatatatttagttattcttaaacaatcagtnggttttgataaagctgtatcttaaaagggacttttatatacaggtaattatcttcaagaaatcctttccacaattttgctcggtgtgntntagttttgtcaacatctatgggtgtattattttttcacatatgtncaaaattctttcattaattccgacgatgggttttgctcacgtgtgagaattcaagctaattctattttttnctcgaggggatgaatngggcagcttcataccacagcaaatta

SEQ ID NO: 755 - DNA, 239 bp, Ctenocephalides felis
  misc_feature (20)..(20): n = unknown
  misc_feature (27)..(27): n = unknown
cagcaattccgcaaaccagngccacanatggtaaatatgatgctatttgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggccgt

SEQ ID NO: 756 - DNA, 420 bp, Ctenocephalides felis
  misc_feature (39)..(39): n = unknown
gttttttgggctagagtgcacagaaaattctctaccggngagaaagtgtatggaaaaattagagaattgtaactatgctgttggatcttgggaaaacagatcaagttctcactagttggtattgctggacaggacatcaagtgaaggaaatgctactttaactttagcgcccatatggcagttgatgagagcttatactttatctgtgttgacacgtttggcaaacactggaagtccaataattgaaagagaaattgttcagtgggtgaataccaagctagcaggtgccaataaaacaacatctttgagtagcttccaagacaaaacaatttcagatgctaaagttgtaatagacttaatcgatgccattaaaccgggaactatcaattatgacttagttaaatcttggaaatcccaaga

SEQ ID NO: 757 - DNA, 414 bp, Ctenocephalides felis
  misc_feature (22)..(22): n = unknown
  misc_feature (396)..(396): n = unknown
catttgtagggtgtccagtgcntccctctcttggactttatctccgtcaatgtggtaaagtagcatttgcccatacacttggtcttcgtctcgactttttcagggatcgtcccaggcaattttcatcattttcatcgcaggaaacacattcgtgttttttagcatcaccattgcattcattttggtcacaagttgggcaacgttctggttttttctcgcacatttttttcagattttggttcttgaacaggttgctggtgcagcctaatttgatggcatcaccttgtgcattcagaatactcaaacaagtatctttaggattgagacaaacttctttggcatcatctttagcattgcaaaccctgcgatttcttgggaaaacatcgatttacaaangttacctttgcactcctg

SEQ ID NO: 758 - DNA, 278 bp, Ctenocephalides felis
  misc_feature (31)..(31): n = unknown
  misc_feature (93)..(93): n = unknown
ttggtccttttatgccatccagtccagttantttcgcaggtcccgcagataataacgagatacatcatgagcttaaaagcctcttttagaacncggccataataaagataatccaactgcataccagcaattcccccccaagcttttagggaaatcaggatgacaccattgcacaggcctttcaggcagcaggtgatggagaatgatcactgctccatatcaatatctctgtttccaaagcttggcataattttcttgatactttcttctctaattgg

SEQ ID NO: 759 - DNA, 403 bp, Ctenocephalides felis
  misc_feature (23)..(23): n = unknown
  misc_feature (86)..(86): n = unknown
  misc_feature (136)..(136): n = unknown
ttatttaaatatttatcatgggnttggtggatccatggataaggtggccgaaatatgcctggacgtaggatggtggtgccaaggantttgggaccgatgggaactttttctttgctggatttcaaaaccaaattgnccaaaattttcttcattttggtgatgggaggcccgagccttgggaaaaatgtattgtcccaggatcacttttatgggaatgatcacgaaggaacatgtgattacgcacaaaatgtagaatgttaccaaccagaataaaacatttttaatatctgacagcgattttctgaaactatattcatactactggtataataaatttatcttcattgctctcctcctataaatttattccggtttaataaaatcaattaaaataaaaataaca

SEQ ID NO: 760 - DNA, 201 bp, Ctenocephalides felis
  misc_feature (62)..(62): n = unknown
  misc_feature (65)..(65): n = unknown
  misc_feature (96)..(96): n = unknown
  misc_feature (139)..(139): n = unknown
gactgccactttagttgccaattccgcagcagggttgtttgtggcaggggtaatcattttcngtngcattttacacatttcaggggatcatttttnttacataggttactattgcactttagacaagacccaagatgtncattttcgcattcttttctaatcgaatcacttcaggtaaatcgaccaaacaacctttttttg

SEQ ID NO: 761 - DNA, 418 bp, Ctenocephalides felis
  misc_feature (21)..(21): n = unknown
  misc_feature (33)..(33): n = unknown
  misc_feature (52)..(52): n = unknown
  misc_feature (221)..(221): n = unknown
  misc_feature (367)..(367): n = unknown
  misc_feature (375)..(375): n = unknown
  misc_feature (391)..(391): n = unknown
ggctttttcttattcaatcanggaagttcacantatataaaaaaaacttggntaaatgtgataaacataaaattggttcctaatgatttgctctacagaaaatttcatcaaaatatttcatatacaatattatgtaaaattaaaatatgtaagttaatacaatttagaatgatatcagtatgacaaattgtggaaatattcctttcaaaagtaaaaacaanaattcggaaatagggaaaaataaaagaaatatttcagaataatttgccttatacttatgaattttaaaagaatattctcctacaaaataccttaacaataccaaattcataacacttgaatataaaaaatctatcttggaataaangggtaggnatttaaacaatccccnttttttcatattccccagcggactggc

SEQ ID NO: 762 - DNA, 204 bp, Ctenocephalides felis
cagttaatgatctacaacttgttcaaaaagccttaactgatggatcgaacgcgtgtggaaggtcaatcgaatccttcctaaatgttattgaaactgaagaagcacctccaacctttaatagaactaacaaattcactcaaggtttccaaaacttgatagatgcctacggagttgctagttacagagaagtaaatccagctctgt

SEQ ID NO: 763 - DNA, 446 bp, Ctenocephalides felis
  misc_feature (390)..(390): n = unknown
taatgtcgtagaaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcaacaaagctgaaatggaggagagtgatacagatcaaagtncagatcgaaaaaatactcctgtcacatgaaggcactgtgtgaggcataggaagtaa

SEQ ID NO: 764 - DNA, 341 bp, Ctenocephalides felis
tgacggtggcaatcagcttctgaacgatttctttttacacatatttttagaatgatcatatacataggttagggtggggcattcgaaaacctgcctttaccatctttgcagaataagtatcttgtgcagctttcggatctggctgatatcctacaaccgcgcatgtagtttctgccgtcttacagttttccccaggttttgatgagcacatatcatctacacaaaatggagcatcggaatttgagtctctgcaattgattggtgtaattggggtttcttgtccagcgcacaacttcaaagtagaacaatcgtgacaaaaatgttcccaactgcttattagt

SEQ ID NO: 765 - DNA, 405 bp, Ctenocephalides felis
  misc_feature (19)..(19): n = unknown
  misc_feature (52)..(52): n = unknown
  misc_feature (54)..(54): n = unknown
  misc_feature (354)..(354): n = unknown
aactttatgcgttatatanataaaatattatggttggaacccaggctcgcgngntatgatatggcatttatgaaattttacaatttagatttttttaaatccatgaatatattttgttctaatcaaaattattcattttacgcttaattttattggttgaactaatagatagatagataaagatatagagttaatataaaaatgaagaaaataaaattaaaagtaagaaataatacggacttctaaatgtagggggaagtcccctagtggcggacacctaaagttatttataaataaatcaaaaaatattttaaaaaccagcaatcaaattaattcatgtcaatggtctcattnctggcttgtgaacagtcttcgctaagaagtcagcaaattcttgatatggag

SEQ ID NO: 766 - DNA, 168 bp, Ctenocephalides felis
cctgcataccagtcagactgtttaggtgcaagtgtcacttcttccccatccataccatccttaccatccttaccatctttcccaaccttgccaacatcttccccaacagcaggacttccctttggccgaaaatctcttgatatgcaaacaaaaactggaactaaatgt

SEQ ID NO: 767 - DNA, 425 bp, Ctenocephalides felis
  misc_feature (8)..(8): n = unknown
  misc_feature (23)..(23): n = unknown
  misc_feature (377)..(377): n = unknown
ttggggcntttaatgacgggcantcagcttctgacgattttttttacacatatttttagaatgatcatatacatagtaggtggcattcgaaacctgacctttaccatctttgcagaataagtatcttgtgcagtctttcggatctggctgatatcctacacccgcgcatgtagtttctgccgcttacagttttccccaggttttgatgagcacatatcatctacacaaaatggagcatcggaatttgagtctctgcaattgattgtgtaattggggtttcttgtccagcgcacaacttcaaagtagaacaatcgtgacaaaatgttcccaactgctattagtcctcggccgcgaccacgctagccgaatttgaaatntcatacactggcggccgtcgacatgcattagagggccaatcgcctata

SEQ ID NO: 768 - DNA, 498 bp, Ctenocephalides felis
  misc_feature (49)..(49): n = unknown
  misc_feature (410)..(410): n = unknown
tggtgactcatttggagttcttgaaggtggttcttctacccaagctttnttagatccctgcatgctcatgttcaagctatgaccaggtggagggatgttcaattatgtcgaattgagagttacattgcgcactccttacacctagtgagttcagaactgttatattctcagctcctgattttgtgaaaagcatatattcttctaaaggtttcatagtatgattgttgacttcaatatatatatttgagaggcatcctgaatagcttttgaatgtagcaaatctgggatcatctgtcgataaaccaccgatttgtatttcattgattccttccttaggagattttacaaaattgacttcgggtaatatttctaaagatacttcagttctgctattaacaatatggagctgntgtgataccttttgtaatagacggatgcctagcaccgtttagaagtttctgctactttggtccaacacagccctctctatcttcttca

SEQ ID NO: 769 - DNA, 350 bp, Ctenocephalides felis
  misc_feature (8)..(8): n = unknown
  misc_feature (10)..(10): n = unknown
  misc_feature (325)..(325): n = unknown
tctttaangntgggtcgattaggaagggtggttggaagcaatgttgtaggaataattctagattataattgcgatttaacatttttaatatcaggaacatctctgatagcatgtggagtgattgcattctttatccgaacatttatcagaagcaagtggatagaagaacgagcattgcttcatatggccataaccatatttccgtcgtgtgttgtgaaatgcaattatactttgagaaagtattatcaattacaaagaaaattcagaagttgctactgaatcattttctaaaacatcgacatgaaaattaataactctttattgntattagattcgatgtaagatatatg

SEQ ID NO: 770 - DNA, 405 bp, Ctenocephalides felis
  misc_feature (352)..(352): n = unknown
  misc_feature (391)..(391): n = unknown
aatgggtttgacccaaaatctttctcgtgcggaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattnaaatgttaaaattgattttatgtaaggagcacaacaaangtcattaactatag

SEQ ID NO: 771 - DNA, 292 bp, Ctenocephalides felis
  misc_feature (38)..(38): n = unknown
  misc_feature (91)..(91): n = unknown
  misc_feature (132)..(132): n = unknown
  misc_feature (216)..(216): n = unknown
  misc_feature (263)..(263): n = unknown
  misc_feature (277)..(277): n = unknown
ttttagaaatgatcatttacatagttagggtggcattngaaacctgacctttaccatctttgcagaataaagtatcttgtgcagtctttcngatctgggctgatatcctacaaccgcgcatgtagtttctgncgcttacagtttccccagttttgatgagcacatatcatctacacaaaatggagcatcggaatttgagtctctgcaattgattgntgttaattggggttcttgtccagcgcacaactcaaagtagaacaatngtgacaaaatgttnccactgcttattaat

SEQ ID NO: 772 - DNA, 498 bp, Ctenocephalides felis
  misc_feature (5)..(5): n = unknown
tgaantgtgaagacgacgtctacgaatggtttgacccaaaatctttctcgtgcagactgcgtgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaagagcacaacaaaatgtcattactattggtaatttctggttatttaaatatataaatttggagctttttgaattcatgttctttttaataaaataaat

SEQ ID NO: 773 - DNA, 459 bp, Ctenocephalides felis
  misc_feature (30)..(30): n = unknown
  misc_feature (436)..(436): n = unknown
aatctttctcgtgcagaactgcatgcaagngtgaaaacgttttttccgatccgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtttttatgtaagggcacaaacaaaatgtcttactatagtaattctgatattttaaatattaatatagaagctttttgaatcaanaaaaaaaaaaaaaaaaaaaaaaa

SEQ ID NO: 774 - DNA, 428 bp, Ctenocephalides felis
  misc_feature (32)..(32): n = unknown
  misc_feature (49)..(49): n = unknown
  misc_feature (63)..(63): n = unknown
  misc_feature (80)..(80): n = unknown
gcccgcccggcggtccaaccggtggcattggnattgcccaacataaatngttgggtccgggcntaggttttaaaaaaatngggatttgggcatttcatgacgggcaatcagcttctgacgatttctttttacacatatttttagaatgatcatatacatagttaggtgggcattcgaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgatggtgtaattggggtttcttgtcagcgcacaacttcaaagtagaacaatcgtgacaaaatgttccactggttattagt

SEQ ID NO: 775 - DNA, 499 bp, Ctenocephalides felis
  misc_feature (408)..(408): n = unknown
  misc_feature (452)..(452): n = unknown
  misc_feature (482)..(482): n = unknown
caatttacaatccagaatcaaatcttacaattagtgtagttgtctatgagagaaaacatcggacgttgggtcacaaaatgattaacagttatagaatgccatgtgtttaatacgcagtttacaatataatgttactattgttagttggcatactgtaccgagttttattttttttatgaaaaagaagatagagtggccaaattattttggtcatgtgatatttgttccattaaagattatatgaggtcatgtgcattgttagtgcatgatttaatatttttgtacgttgcggaattgatttgtggtggagatactgtattaaaggtttcaaatagttttgaaactgctcttgtgtgaaattagtaatagctccaattcaatctaggatgcttggtcttcctttatgtncagcacttgtatactttatctacttatcaattattttagaccangctcgcccttggccagaatatttgaccganttaaagtttaatgatcc

SEQ ID NO: 776 - DNA, 393 bp, Ctenocephalides felis
  misc_feature (345)..(345): n = unknown
  misc_feature (365)..(365): n = unknown
  misc_feature (384)..(384): n = unknown
catatttataaatttttttggcttatttctagaatttattcagcattagaacattttgaataattttcttgaatattgtgatacctcgaaggaaagtttctgtatctaaatattcatcatggtcatgcagcaatactggcgtgttattcatgggagaaaaaccaaaagccggcagtccaatttctcttatatatctgctatctgttgcagctggaaaaacttgtggtcaagaacaagtcccatttcatcagtagctcttttaaatgctgccaaattttattgcttcattcagttcagtgttgctatcagtggtctttttggtcaaatctatttcaacatccttgncagctctttgcccatttcgnatctttcttccaatcctgnggctaagga

SEQ ID NO: 777 - DNA, 498 bp, Ctenocephalides felis
  misc_feature (22)..(22): n = unknown
  misc_feature (47)..(47): n = unknown
  misc_feature (71)..(71): n = unknown
  misc_feature (92)..(92): n = unknown
  misc_feature (312)..(312): n = unknown
  misc_feature (370)..(370): n = unknown
  misc_feature (423)..(423): n = unknown
  misc_feature (457)..(457): n = unknown
  misc_feature (459)..(459): n = unknown
  misc_feature (478)..(478): n = unknown
  misc_feature (493)..(493): n = unknown
tgaaatgtgaagacgacgttcnacgattggtttgacccataaatctntctcgtgccagaactgcatgcaanagtgaaaacgttttttcccgntcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtngtcaattaatataataaatacacaaatgatctgtgcaattaaatataaaaaatatgtntaaaaattaaaatgtttaaaattgtatttatgtaaggagcacaaacaaaatgncattaactatagtaattctgattattcaaatatntnaatatagaagcttttgaancacacataaaaaaanaaaaa

SEQ ID NO: 778 - DNA, 363 bp, Ctenocephalides felis
  misc_feature (118)..(118): n = unknown
  misc_feature (166)..(166): n = unknown
  misc_feature (192)..(192): n = unknown
  misc_feature (270)..(270): n = unknown
ttcgttccattttctgataaccttaaaaaactatttgcgggaaaactaaaaattttgtttgggagaaaaatattagaaaaattggaataggtctaaaacattttcctaacatagggangaccctacagcaactcgggtatactcaaaaaagtttgttgaaaagttngataaatattcacagcgcttcactgntttgttcttgagtttaggaaaaggcatttatttataacttttggaccggtttatttgattgaaatgaaatattcggcnaatttatagaaaattaaataatctacaaatttttcttttccgcaccagaaaccaccaaaatattccttcggcttatacgggtaaacatcacaa

SEQ ID NO: 779 - DNA, 428 bp, Ctenocephalides felis
  misc_feature (20)..(20): n = unknown
  misc_feature (191)..(191): n = unknown
  misc_feature (207)..(207): n = unknown
  misc_feature (387)..(387): n = unknown
  misc_feature (393)..(393): n = unknown
  misc_feature (410)..(410): n = unknown
tccttaatatctaccatggngatttcagggtttaaaatcacgggaagaacatattttggcgggtaaatattcgaaagctcaatacacaagcggtataaatctagaagtttttcatcaaaacattttgctttatgcaacgccgccagacatcacctccagacatgctttcattaggaaatcaagtatttggnatctttatatgtgtgnataatctgcatataaatgggctgcacaactagccataacatgcttctcattgtaaacgtgctgctgtgtgctgctgaacaatatcaactttctggagacattttagagcaaatgtcttgtctgggtggtggatgactgacagttcacgcgaccaatccgccacgcccaagtccttggcgngacccnctaaccgatttgagatntctcacactggcggcgtc

SEQ ID NO: 780 - DNA, 331 bp, Ctenocephalides felis
  misc_feature (18)..(18): n = unknown
  misc_feature (46)..(46): n = unknown
  misc_feature (50)..(50): n = unknown
  misc_feature (133)..(133): n = unknown
  misc_feature (148)..(148): n = unknown
  misc_feature (214)..(214): n = unknown
  misc_feature (229)..(229): n = unknown
  misc_feature (268)..(268): n = unknown
  misc_feature (270)..(270): n = unknown
ttttttttttcataatcnaatctataatcagtttattaatataatnggtnggtataaaaatagtccttaaaaaatacatgaatgaaatttggcgaaatgtaaattcaaaaatatataaaatatttaaaaaatntagtcatattttganggttacaggaacatgtccccttcagtatttcttttattttcaattacgaaaatcagaaaacagttnttccaagatcatggntcttgttcccttctttaagcttatttcctatcctaaagngntaactattactcctaaactgcgatgatatttgtgatgaatgatgttgacatgatgtccgaa

SEQ ID NO: 781 - DNA, 271 bp, Ctenocephalides felis
  misc_feature (19)..(19): n = unknown
  misc_feature (45)..(45): n = unknown
  misc_feature (128)..(128): n = unknown
  misc_feature (254)..(254): n = unknown
ttctattgggaaaaactgnacttactaaggaggcattagtgctgntttgtcgtacactttgattaaataaaggcttcaacattttcacttagtgaaaatttgagggtagggtttgattttagtgatgnttaaaatgatgtaaaataatactgccttttattataagaacttcttatattatataaacaggtatgatcttggttttgacaaaagtttgtaatattggttttgggtatattgagcaaaatccctgntggctccacaagcaaga

SEQ ID NO: 782 - DNA, 431 bp, Ctenocephalides felis
  misc_feature (49)..(49): n = unknown
  misc_feature (59)..(59): n = unknown
  misc_feature (82)..(82): n = unknown
  misc_feature (90)..(90): n = unknown
  misc_feature (140)..(140): n = unknown
  misc_feature (259)..(259): n = unknown
  misc_feature (426)..(426): n = unknown
ggcccgccgggccgtacaattcggtaattcctagggaatgtaaaacaanaatataatanaacaataattcgatttcaacaangatattgnattttaattttaatttatattgatcacaaattaataactcgttacattgnaataatactaaacaatctatttacaattaaaaacactcctttcgcaaactttaattctccttcttgatgcgtgtggatgtcattctgtaaataatggagtccctgccagggtccattgnggagatcgagatcagatagcaagtaacgagaagaaaaaggctctcccaaccataaaatgatgttaaaaaccaccgggtaggagtcgttgtattctttactaggtgaaatcgggttcttttggagcatcatctgcttgccttgcttacgtgttaagacgtcattaganggtag

SEQ ID NO: 783 - DNA, 208 bp, Ctenocephalides felis
  misc_feature (16)..(16): n = unknown
  misc_feature (99)..(99): n = unknown
ggaagcccttagctgngcaggacatgtaactgtatagcattttgtgcccagagccataggtccgcaattatgacgtaacggatcatatgcaaaatttgnggggcaataatattgggttcctatactattttcgtcacaataataatagctttgacaatcatttatatttggataaaatctcgatggtgacggacatttgaaaccttgt

SEQ ID NO: 784 - DNA, 388 bp, Ctenocephalides felis
  misc_feature (55)..(55): n = unknown
  misc_feature (348)..(348): n = unknown
cctggtcaggcccatccaagagtgggaactttttcaggaaagctactagaggggngtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggntatatacagcattcaaaaaaaaaaaaaaaaaaaaaaaaaa

SEQ ID NO: 785 - DNA, 498 bp, Ctenocephalides felis
  misc_feature (23)..(23): n = unknown
  misc_feature (33)..(33): n = unknown
  misc_feature (402)..(402): n = unknown
  misc_feature (447)..(447): n = unknown
  misc_feature (449)..(449): n = unknown
  misc_feature (477)..(477): n = unknown
  misc_feature (479)..(479): n = unknown
tgaaatgtgaagacgacgtcacntatggtttgncccaaaatctttctcgtgcagggctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtattaaaatttaaatgtataaaattgattttatgtaagngcacaaaccaaatggcattactataggaattctgatatttaaatntntaaatataggagctttttgaatttaaantnaaaaaaaaaaaaaaaaaaa

SEQ ID NO: 786 - DNA, 438 bp, Ctenocephalides felis
  misc_feature (90)..(90): n = unknown
  misc_feature (106)..(106): n = unknown
  misc_feature (230)..(230): n = unknown
  misc_feature (257)..(257): n = unknown
  misc_feature (295)..(295): n = unknown
  misc_feature (305)..(305): n = unknown
tttttatttttggtcatcattatttaagacataacttattcctgggtagaccacaagatatattagagtaaataaactcactttaaaagnggatttttgataatgnatatgtgaatgctctttgagtcccaaaaatatataagtattttataaaccgatgaaaaactgaacagtccattgcacaaacaactatttagcttgatcattaagttgatacatgtaaaaattgncactcgcatacaaagatttttaaatgntaatttaaggttacatttatttggttatataattctgnatttgagggnaataagaacgtagattattgagtcaaatcaaatctattcttgacatgccaatggctagtgatctatttaaaactatattcgagcatttgattaaattttcatctacgtggtgggtatgttaagaatgtttttg

SEQ ID NO: 787 - DNA, 350 bp, Ctenocephalides felis
  misc_feature (19)..(19): n = unknown
  misc_feature (67)..(67): n = unknown
  misc_feature (115)..(115): n = unknown
  misc_feature (128)..(128): n = unknown
  misc_feature (152)..(152): n = unknown
  misc_feature (205)..(205): n = unknown
  misc_feature (208)..(208): n = unknown
  misc_feature (214)..(214): n = unknown
  misc_feature (236)..(236): n = unknown
  misc_feature (338)..(338): n = unknown
  misc_feature (341)..(341): n = unknown
aaattaatggtcctttcgncccatgaaatcaagaaattgttgtaaattaagcaataaacaaccatancaaaaaaagagaaaaatctaaaaacaatttaaattagcaaaaccaagngtatttgaatttnatttttgcacaagttcctttttgnattaaaatatatgtatatttatgaatatgtatttcttggattttagggtaaantcnttatanaataatttggaaatacatattnataatgctaaagtttaaattggcttttttccattaaaatcctttttaacattatacatatattttattgcaaatgtgaggcggtatggaatcaccgggtggntgntttctgagt

SEQ ID NO: 788 - DNA, 428 bp, Ctenocephalides felis
  misc_feature (139)..(139): n = unknown
tatcttatttccgtggcgcccagcttttgaaccagcttgcatttaaaattctttcttcagcttgaaagtgaaaagatgtttccagaggggtggctataattcccgattttgccacatttatatcccaaagaactaagtnaatcagacagggcctgaattatcaagtgctaagactattgtatcaggaggacgtggtttaaagtctggtgataatttcaaattattatttgacttagcggataagataggagctgcagtaggcgcttctagagccgcggtagatgctggattttgccaaatgatatgcaaatcggcagacagggaagattgttgcacctgactctatattgctgtggaatatctggagcaattcaacacttactggaatgaaaagatctaaactattgtgcatcaataagatccagagg

SEQ ID NO: 789 - DNA, 487 bp, Ctenocephalides felis
  misc_feature (48)..(48): n = unknown
  misc_feature (77)..(77): n = unknown
  misc_feature (154)..(154): n = unknown
  misc_feature (164)..(164): n = unknown
  misc_feature (174)..(174): n = unknown
  misc_feature (229)..(229): n = unknown
  misc_feature (327)..(327): n = unknown
  misc_feature (344)..(344): n = unknown
  misc_feature (356)..(356): n = unknown
  misc_feature (414)..(414): n = unknown
tttttttttttttttttttttttttgggtaaattttaggctggagggntgctctggtggtaatagaacaatttttgntaatctaaaatttggattaatctattacatttaatcattcaatagtaaattcctttttggaatttcgaatggggtgnccattacggnaaacaaagtntcctcgtcaacagttgcatgaactttgccttcaacgtcattcctaagtatggggnttctttattcttgggttggattatgtctttagtgaccttaaattcctcctcaggatcccaaataactaaatcaagcatccaagccttctttgatttgnccttttatgccatcagnccagttaatttngcaggcccgcagataataaacgagatcatcatgagctttaaagccccttttagaagcncggccataataagataatccaaattgcatccaccaattccccccatgctttaggaataaggatgaaaccattg

SEQ ID NO: 790 - DNA, 500 bp, Ctenocephalides felis
  misc_feature (206)..(206): n = unknown
  misc_feature (280)..(280): n = unknown
  misc_feature (468)..(468): n = unknown
ttttttttttgcaaaggacggcccaaacgatttatttttattaaaaagatcatggagtttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggnttaagccttacttagcaatctcacttttgcattcttcgccgggtggcgtgggtatgcatcgcaactccgttttatcaaagtgcaagccatttggacaatcataatggtttatttgccattggtggtaaccaagaaacattgataatatttttacaatctcttcgatcggaaaaacggtttcacttttnatgcagtctgcccgagaaagattttgggcaac

SEQ ID NO: 791 - DNA, 396 bp, Ctenocephalides felis
  misc_feature (46)..(46): n = unknown
  misc_feature (77)..(77): n = unknown
  misc_feature (90)..(90): n = unknown
  misc_feature (104)..(104): n = unknown
  misc_feature (112)..(112): n = unknown
  misc_feature (135)..(135): n = unknown
  misc_feature (174)..(174): n = unknown
  misc_feature (181)..(181): n = unknown
  misc_feature (227)..(227): n = unknown
  misc_feature (276)..(276): n = unknown
  misc_feature (279)..(279): n = unknown
  misc_feature (281)..(281): n = unknown
  misc_feature (283)..(283): n = unknown
  misc_feature (312)..(312): n = unknown
  misc_feature (341)..(341): n = unknown
ccgagcggccgcccggccgggacccctacaaactcaaggcaatggncaggatgggaaaatcttttaatggatggggncgaataagaaagnggtggcgggaagcnaaggttgnaggaaaaaattctagaatataantgcgatttaacatttttaatatcaggaacaatctctganagcatgnggaggggattggattctttatacccgaacatttatcagaagcaagnggatagaagaacgagcattgcttcatatggaccataaccatatttccgncgngngntgggaaatacaattatactttgagaaagnattatcaattacaaagaaaattcagaagntgctactgaatcattttctaaaacatcgacatgaaaattaataactctttattgg

SEQ ID NO: 792 - DNA, 408 bp, Ctenocephalides felis
  misc_feature (321)..(321): n = unknown
atactagggatgtaaaacaaaaatataattagaacaataattcgatttcaacaaagatattgggttttaattttaatttatattgatcacaaattaataactcgttacattgtaataatactaaacaatctatttacaattaaaaacactcctttcgcaaactttaattctccttcttgatgcgtgtggatgtcattctgtaaataatggagtccctgccagggtccattgtggagatcgagatacagatagcaagtaacgagaagaaaaaggctactccgaaccataaaatgatgttaaaaaccaccgggtaggagtcgntgtattctttactaggttgaaatcgggttcttttggagcatcatctgcttgccttgcttacgtgttaagacgtcattagagggtagt

SEQ ID NO: 793 - DNA, 221 bp, Ctenocephalides felis
  misc_feature (64)..(64): n = unknown
  misc_feature (217)..(217): n = unknown
tatataatctgactctcgatttgtatcttcataactgattctcagatatccattaccggaatgntcatcattacgtctgagttgtccactaaattcaactttttttccattttcttccatgacatgtctgaattttattttaccatcaactaaagattccatgtgagctcttgcgcaagttccatctcgttcaaaatgattttggtatctatattgntcgt

SEQ ID NO: 794 - DNA, 441 bp, Ctenocephalides felis
  misc_feature (70)..(70): n = unknown
tttttttggatttatattcccctattatataaatacaatttattataaaattaactatctaatatatccngtgtaattaattattttaataaccgattttttacttttttataatatatatgtattatattccctattatataatacaatttattataaaattaactatctaatatatcccgtgtaattaattattttaataacgatttttttactttttataatatatatgtattatattccctattatataatacaatttattataaaattaactatctaatatatcccgtgtaattaattattttaataacgattttttacttttttataatatatatgtattatattgcaaaaatgtaaaaaagtaaaatttagttgcgtgaattcgtgcagttcacccgaaatgcagtattgccggaaataggagcagaccggtta

SEQ ID NO: 795 - DNA, 419 bp, Ctenocephalides felis
  misc_feature (381)..(381): n = unknown
  misc_feature (391)..(391): n = unknown
  misc_feature (405)..(405): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcctgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgnataaaattgnattttatgtaaggngcaccaaccaaatg

SEQ ID NO: 796 - DNA, 417 bp, Ctenocephalides felis
  misc_feature (47)..(47): n = unknown
  misc_feature (107)..(107): n = unknown
  misc_feature (127)..(127): n = unknown
  misc_feature (138)..(138): n = unknown
  misc_feature (185)..(185): n = unknown
  misc_feature (195)..(195): n = unknown
  misc_feature (251)..(251): n = unknown
  misc_feature (256)..(256): n = unknown
  misc_feature (265)..(265): n = unknown
  misc_feature (275)..(275): n = unknown
  misc_feature (285)..(285): n = unknown
  misc_feature (288)..(288): n = unknown
  misc_feature (292)..(292): n = unknown
  misc_feature (325)..(325): n = unknown
  misc_feature (333)..(333): n = unknown
  misc_feature (344)..(344): n = unknown
  misc_feature (358)..(358): n = unknown
  misc_feature (379)..(379): n = unknown
  misc_feature (382)..(382): n = unknown
gaactgcatgcaaaagtgaaaacgttttttccgatcgaagagattgnaaaaaatattatcaatggttcttggttaacaacaaatggcaaataaaacattatgattgnccaaatggcttgcactttgntaaaacggagntgcgatgcataccccccccccggcgaagaatgcaaaagtgagattgntaagtaaggnttaagccaggaaaacaatcttgaatagactaattaggattcaaattatcataaagnagtcnattaatatnataaatcccnaatgatctgngcnattnaatattaaaaatatgtttaaaattaaaatgggntaaaatgnatttatggtangggcccaaccaaangctttacctttgtaattctgnttntttaaatatataaatttagaactttttgaaattgg

SEQ ID NO: 797 - DNA, 338 bp, Ctenocephalides felis
  misc_feature (296)..(296): n = unknown
  misc_feature (306)..(306): n = unknown
tataattttatgtattgggattaaccttagttaaattctccctcgcaatttttatactatagtaacccagaaacaaaaatcagagtgtgtaaaaatgtaaattcatatatttttggtaaaaatacaatcaagatataacagtgccacaatattattaaaatacgtatttgtgacgaaacctaaagtgtagtcagaatataaaaaacaataatatttataccttcaaatgtatgctttgaaaaaaagcattcgaagattttgtttaaatattttgttaagtccacatttatgtttgntcgtcaattnaattatgtttcttttgcaagtaagattatgtg

SEQ ID NO: 798 - DNA, 498 bp, Ctenocephalides felis
  misc_feature (103)..(103): n = unknown
  misc_feature (251)..(251): n = unknown
  misc_feature (282)..(282): n = unknown
  misc_feature (316)..(316): n = unknown
  misc_feature (321)..(321): n = unknown
  misc_feature (324)..(324): n = unknown
  misc_feature (330)..(330): n = unknown
  misc_feature (332)..(332): n = unknown
  misc_feature (353)..(353): n = unknown
  misc_feature (380)..(380): n = unknown
  misc_feature (401)..(401): n = unknown
  misc_feature (404)..(404): n = unknown
  misc_feature (426)..(426): n = unknown
  misc_feature (435)..(435): n = unknown
  misc_feature (447)..(447): n = unknown
  misc_feature (455)..(455): n = unknown
tggaatgtggaagacgacgtcaacggatggtttggcccaaaatctttcttcgtgcagaactgctgcaaaagtgaaaacgttttttcccgatcgaagagattgnaaaaaatattatcaatgtttcttggttaacaacaaatggcaaataaaacattatgattgccaaatggcttgcactttgataaaacggagttgcgatgcatacccacgcccccggcgaagaatgcaaaagtgagattgctaagtaaggnttaaaccaggaaaacaatcttgaatagactnattaggattcaaattatcataaagtagtcaattnatatnatnaatacncnaatgatctgtgcaattaaatntaaaaatatgtttaaaattaaaatgtntaaattgtttttatgttaggngcncaaccaaatggcattactttanaatttctgntatttaaaattnttaatatngagcttttgaagggaaaaaaaaaaaaaaaaaaaaaaaaaaaga

SEQ ID NO: 799 - DNA, 411 bp, Ctenocephalides felis
  misc_feature (263)..(263): n = unknown
acacaattagcaataggaaaatctagccacaaatatttttaacaatttatttaatacttatgttctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatntaacagaaagaacaaaataattttaatgttattaaaaattacatataaaataacttttacaataaagtaaccttacatgagatgtgttgatttcagatcttttcatacaacagtgctttctgtataaacaatataatataaataacgg

SEQ ID NO: 800 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtatttctgattatttaaaatatataaatatagaactttatgaaattacatgtatctttttataaaa

SEQ ID NO: 801 - DNA, 154 bp, Ctenocephalides felis
  misc_feature (29)..(29): n = unknown
  misc_feature (74)..(74): n = unknown
ccattaaactctttttgatggcataaaangctggcaaaagagtgcacttaatcggattatgttgaggccacttnattaacacctttgttctaggtatgttatatacctctgggttggctagtcttagaacgcattgtttgtgtgaggctttagt

SEQ ID NO: 802 - DNA, 420 bp, Ctenocephalides felis
  misc_feature (382)..(382): n = unknown
  misc_feature (392)..(392): n = unknown
  misc_feature (401)..(401): n = unknown
ctgaatgtgaagacgacgtcaacgaatgggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgnataaaattgnattttatgnaaggagcacaaacaaaatg

SEQ ID NO: 803 - DNA, 95 bp, Ctenocephalides felis
gcactgctgcagaacgctgttgaaatataactcagctgcacaagcatatcgggccacgtcgaatacaccttgagcgtttaatgtgcactcgtagt

SEQ ID NO: 804 - DNA, 211 bp, Ctenocephalides felis
ggaagcaccttaggctgtgcagggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgt

SEQ ID NO: 805 - DNA, 335 bp, Ctenocephalides felis
  misc_feature (63)..(63): n = unknown
  misc_feature (71)..(71): n = unknown
  misc_feature (181)..(181): n = unknown
  misc_feature (313)..(313): n = unknown
  misc_feature (322)..(322): n = unknown
gtctccagaccctgctattatcgggtcgagtttgcaaaaagagtttatttaatttattggtgnccgcccgngttaaattaaagtaaactttttcaagatgatgccccgcacttgcagacccagtggctttcgccaaggatttcgccgcaggtggtatttctgccgcagtctctaagactgnggtagcacccatcgaacgtgtcaaattgctcctgcaagtcaacacatttccaaacaaattgctgaggataaacgttacaaaggtatcatcgattgctttgtcgtatccctaaggagcagggcgtctttcttntggcgtggnaacttggccaatg

SEQ ID NO: 806 - DNA, 287 bp, Ctenocephalides felis
  misc_feature (21)..(21): n = unknown
  misc_feature (47)..(47): n = unknown
  misc_feature (63)..(63): n = unknown
  misc_feature (105)..(105): n = unknown
  misc_feature (122)..(122): n = unknown
  misc_feature (133)..(133): n = unknown
  misc_feature (199)..(199): n = unknown
  misc_feature (273)..(273): n = unknown
  misc_feature (278)..(278): n = unknown
acggggggcttctcttttccnaacttaagcagaattggtgaacaggngaccattccaatctgncggacttgatttctgtagcatattcatcaaatgagctaaggncttgaatggaagcttgnaatttttcggncaaatattcaacatcagcaacgatatcctcatcatctgacgtctttgttccaggatggataattgnttcaataccttgctttgcccattgcaatgcaatgctccttggcccctgtgatcttcactttctcaattaaaatnctatnaacaggcag

SEQ ID NO: 807 - DNA, 132 bp, Ctenocephalides felis
  misc_feature (56)..(56): n = unknown
  misc_feature (58)..(58): n = unknown
attgtctttggagtctcaagaactaattccagttgaaacaaattccagcagcgttngnatttgggcagcaaccattcatttgtccaagagttggactatttcgcgatccattggatcctacatgcaaaaggg

SEQ ID NO: 808 - DNA, 500 bp, Ctenocephalides felis
  misc_feature (3)..(3): n = unknown
  misc_feature (15)..(15): n = unknown
  misc_feature (17)..(17): n = unknown
  misc_feature (21)..(21): n = unknown
  misc_feature (46)..(46): n = unknown
  misc_feature (52)..(52): n = unknown
  misc_feature (62)..(62): n = unknown
  misc_feature (110)..(110): n = unknown
  misc_feature (178)..(178): n = unknown
  misc_feature (323)..(323): n = unknown
  misc_feature (325)..(325): n = unknown
  misc_feature (348)..(348): n = unknown
  misc_feature (356)..(356): n = unknown
  misc_feature (386)..(386): n = unknown
  misc_feature (393)..(393): n = unknown
  misc_feature (429)..(429): n = unknown
  misc_feature (452)..(452): n = unknown
  misc_feature (458)..(458): n = unknown
  misc_feature (465)..(465): n = unknown
  misc_feature (484)..(484): n = unknown
  misc_feature (498)..(498): n = unknown
ccnaggagactttgntnccgnatgggacaccattcgaaattcaaanggaaatttactattgnatggattaaatgtaatagattaatcaaattttagatgattaaaattgntctattactacaatagcaacctctgcctgaaaattaaccgaacaaacttctaacatccttattaatgnatagattttgaataataacatagaaattatactatttttttgatgactctaataaaaaaaatgtataaatggccatgcctgatatatttttgataaccttaatgaaaaaatgtttaaatggccatgtctgaaaagatttctatgngnatttttttggtaacatttattgntgaatggntaaaaagataaataccattttataagctgnttggatnaattattttggataaatccatatcatagaattggtnagtggcaaattaaaatatggccncaaccncaaaagntttcgaaatataacttatntggttttgggaaanaa

SEQ ID NO: 809 - DNA, 414 bp, Ctenocephalides felis
  misc_feature (383)..(383): n = unknown
  misc_feature (410)..(410): n = unknown
cgttatttatattatattgtttatacagaaagcactgttgtatgaaaagtatctgaaatcaacacatctcatgtaaggttactttattgtaaaagttattttatatgtaatttttaataacattaaaattattttgttctttctgttagatgaattgtgtgttagatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattgttaaaaatatttgngggctagattttcctattgctaattgngtgg

SEQ ID NO: 810 - DNA, 376 bp, Ctenocephalides felis
  misc_feature (83)..(83): n = unknown
  misc_feature (327)..(327): n = unknown
  misc_feature (329)..(329): n = unknown
  misc_feature (357)..(357): n = unknown
ttttttttttttttttaatgctgtatataacctttatttatggatgcataggtagatgtgtgccaaatttaaaatactattgnatatttaattttttttctatattcacattttcattatatttctaatctaatatccccaaatttcaactaagaagttaaatcctttgccagtctgagaagataggagtaaagttacatttttccagccaactccaccattgacaagagtggcatagcctccttggccatttacatattggtccagggcacgaacacagctaattgtgcgattatttctcgatcccactggtggaaatgacacctntntagtagctttcctgaaaaagttccactnttgggattggacttgacgg

SEQ ID NO: 811 - DNA, 427 bp, Ctenocephalides felis
  misc_feature (247)..(247): n = unknown
  misc_feature (275)..(275): n = unknown
  misc_feature (356)..(356): n = unknown
  misc_feature (375)..(375): n = unknown
attggtgaaagtgcatttattcgttacatttctgataacttaaaaactatttgcggaaaactaaaaatatgtttggagaaaatatagaaaattgaatagtctaaaacattttcctaacataggaagaccctacagcaactcggtatactcaaaaaagtttgttgaaaagttgataaatattcacagcgcttcactgttttgttcttgagtttaggaaaagtgcatttatttataacttttgaacggnttatttgattgaaatgaaatattcggcnaatttatagaaaattaaataatctacaaatttttcttttacccgcaacagaaaccaacaaaatattcctttcgcttatccnggtaaccatcacaaaatgnatcgaatcaatattttttaaaattggaaatttgcaaatgataaatggaattg

SEQ ID NO: 812 - DNA, 456 bp, Ctenocephalides felis
  misc_feature (99)..(99): n = unknown
  misc_feature (179)..(179): n = unknown
  misc_feature (242)..(242): n = unknown
  misc_feature (251)..(251): n = unknown
  misc_feature (300)..(300): n = unknown
  misc_feature (332)..(332): n = unknown
  misc_feature (357)..(357): n = unknown
tttttttttttttttttttttttttggatttcataaagcttctatatttatatattttaaataatcagaaattactatagttaatgacattttgtttgngctccttacataaaatacaattttatacattttaatttttatacatattttttatatttaattgcacagatcatttgggnatttattatattaattgactactttatgataatttgaatcctaattagtctattcaagattgntttcctggnttaagccttacttagcaatctcacttttgcattcttcgccgggtggcgngggtatgcatcgcaactccgttttatcaaagngcaagccatttggacaatccaatgntttatttgccatttggtggtaaccaagaaacatgataatattttttacaatctctttcgatcgggaaaaacggtttcacttttggctgcagtctgccga

SEQ ID NO: 813 - DNA, 321 bp, Ctenocephalides felis
  misc_feature (72)..(72): n = unknown
  misc_feature (81)..(81): n = unknown
  misc_feature (126)..(126): n = unknown
  misc_feature (132)..(132): n = unknown
  misc_feature (137)..(137): n = unknown
  misc_feature (254)..(254): n = unknown
  misc_feature (289)..(289): n = unknown
  misc_feature (305)..(305): n = unknown
tttggggagaagaaatgggcttatcaaaacctgggggaaactggtagaagggagaaactcatgcgcgggtgnagggatatnagccagatccgaaagactggcaagatcttattctgcaaagatggnaaaggncaggntttcgaatgccccctaactatgtatatgatcattctaaaaatatgtgtaaaaagaaatcgcagaagctgattgcccgcatgaaatgccaaatccaattttttatacctatgcccggnccatcaatttatgctttggtgcaatgacaaattgnaaccattcgttgacgncggctttacatttaat

SEQ ID NO: 814 - DNA, 388 bp, Ctenocephalides felis
  misc_feature (49)..(49): n = unknown
  misc_feature (98)..(98): n = unknown
  misc_feature (103)..(103): n = unknown
  misc_feature (149)..(149): n = unknown
  misc_feature (152)..(152): n = unknown
  misc_feature (236)..(236): n = unknown
  misc_feature (239)..(239): n = unknown
  misc_feature (248)..(248): n = unknown
  misc_feature (302)..(302): n = unknown
cgaattctttttacacatatttttagaatgatcatatacatagttaggngggcattcgaaaacctgcctttaccatctttgcagaataagtatcttgngcagnctttcggatctggctgatatcctacaaccgcgcatgtagtttctgncgncttacagttttccccaggttttgatgagcacatatcatctacacaaaatggagcatcggaatttgagtctctgcaattgattgntgnaattggggnttcttgtcagcgcacaacttcaaagtagaacaatcgtgcaaaatgtcccactgnttattagtaccttggccgggaccccctaagccgaattaaggcgcaaggctgttaaggaagcggacacgtagaaagccagtccgcag

SEQ ID NO: 815 - DNA, 209 bp, Ctenocephalides felis
  misc_feature (31)..(31): n = unknown
  misc_feature (147)..(147): n = unknown
  misc_feature (206)..(206): n = unknown
cagttaatggatctacaacttgttcaaaaanccttaactggatgggatcgaacgcgtgtgggagttcaatcgaatccttcctaaatggtaatggaaactgaagaaacacctccaacctttaatagaactaacaaattcactcaaggnttccaaaacttgatagatgcctacggagttgctagttacagagaaagtaaatccagctntgt

SEQ ID NO: 816 - DNA, 268 bp, Ctenocephalides felis
  misc_feature (176)..(176): n = unknown
  misc_feature (180)..(180): n = unknown
  misc_feature (249)..(249): n = unknown
actatagttaatgaccattttgtttgtgctccttacataaaatacaattttatacattttaatttttatcatattttttatatttaattgcacagatcattcgtgtatttattatattaattgactactttatgataatcttgaatcctaattaggctattcaagattgttttccngggntaagccttacttagcaatctcacttttgcattcttcgccgggtggcgtgggtatgcatcgcaactccgntttatcaaagtgcaaagcc

SEQ ID NO: 817 - DNA, 385 bp, Ctenocephalides felis
  misc_feature (363)..(363): n = unknown
atatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacactttctaatcgacccatcattaaagatatacatactgncattgcctgagttgtgtagggt

SEQ ID NO: 818 - DNA, 321 bp, Ctenocephalides felis
aaaaggattcagtagcaacttctgaaattttctttgtaattgataatactttctcaaagtataattgcatttcacaacacacgacggaaatatggttatggccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttctaatcgacccatcattaaagatatacatactgccattgcctgagttgtgtaggg

SEQ ID NO: 819 - DNA, 270 bp, Ctenocephalides felis
cagatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 820 - DNA, 348 bp, Ctenocephalides felis
  misc_feature (27)..(27): n = unknown
  misc_feature (29)..(29): n = unknown
  misc_feature (93)..(93): n = unknown
  misc_feature (149)..(149): n = unknown
tttggaccgacggattttatttaaaancnatttcctttttaattaaaatttaccttctcttggatacttcttattctttgggacctctaaagntctttccagtagttcatccatagcttctatcaagctagtccgataattttcattgntctcatgagatccaaacagtctgctttctcattccattaacaagtccgatcaaactcctcagaatcgtgggctcaaaactgccagtatttcaggagggcatttgagtaagaggcaatgtcatcaccgccaaattttacgcacaaacgcaatcatctgtgctatcatcaaactcttgttcaggaattatatcggttacat

SEQ ID NO: 821 - DNA, 348 bp, Ctenocephalides felis
  misc_feature (54)..(54): n = unknown
  misc_feature (152)..(152): n = unknown
  misc_feature (195)..(195): n = unknown
aaagtagcatttgcccatacactttggtcttcgtctcgactttttcaggaacgnccaggcaattttcatcattttcatcgcaggaaacacattcgtgttttttagcatcaccattgcattcattttggtcacaagttgggcaacgttctggntttttctcgcacatttttttcagattttggttcttgaacaggntgctggtgcacctaatttgatggcatcaccttgtgcattcagaatactcaaacaagtatctttaggattgagacaaacttctttggcatcatctttagcattgcaaaccctgcgaattcttgggaaaacatcgatttaccaaaggtaccttgc

SEQ ID NO: 822 - DNA, 413 bp, Ctenocephalides felis
tttttttttttaaacttcataaaatcattataattcttaaacaattataaatgaatgctgtatataacctttatttatggatgcatagatagatgtgtgccaaatttaaaatactattgtatatttaattttttttctatattcacattttcattatatttctaatctaatatccccaaatttcaactaagaagttaaatcctttgccagtctgagaagataggagtaaagttacatttttccagccaactccaccattgacaagagtggcatagcctccttggccatttacatattggtccagggcacgaacacagctaattgtgcgattatttctcgatcccactggtggaaatgacacctctctagtagctttcctgaaaaagtttccactcttggattggacttgacgg

SEQ ID NO: 823 - DNA, 351 bp, Ctenocephalides felis
  misc_feature (54)..(54): n = unknown
  misc_feature (340)..(340): n = unknown
gggcgaattaggaagtggttgtgggagcaatggtggtaggaaataaatctagantattaatggcgattaacatttttaaatatcagggaaccatctctgatagcatggtggaggtggattgcattcttttatccggaacatttatcagaaagcaagtgggatagaaagaacgagcatttgcttcatatggccataaccatatttccgcgtgtgttgtgaaaatgcaattatctttgagaaagtattatcaattacaaagaaaattcagaagtgctctgaatcattttctaaaacatcgacatgaaaattaataactctttattggtattagattcgatgnaagatatatgt

SEQ ID NO: 824 - DNA, 367 bp, Ctenocephalides felis
  misc_feature (41)..(41): n = unknown
tttgctggaaagaagctttgggcgggcgaaatgggcctggnccgctttcttcgtgcctttacgggtatccgcccggctcccgaattcgcaacgcatcgcctttctatcgccttctttgacgaagttctttcttgaattggaaaaaaggaagagtatgaagtattcaacatttcccgggtcgccctttattcccttttttgcgggcatttttgccttccttgtttttgctcacccagaaacgctggtgaaagtaaaagatgctgaagatcaagttgggtgcacgagtgggttacatcgaactggatctcaacagcggtaaagatcctttgagagtttcgccccgaagaacgttttccaatgatgagca

SEQ ID NO: 825 - DNA, 291 bp, Ctenocephalides felis
  misc_feature (13)..(13): n = unknown
  misc_feature (36)..(36): n = unknown
  misc_feature (241)..(241): n = unknown
gcttggaattctngacgaaattggagaaaaactttntctcacaagggtaaattatgagaaaccgcacaaggtttggaatctttgacattgggctgggaaattgttggcgtatctttccccaagggagatgttggaagagaaatacccgcttcaccctcggcgagttttacccacgtgattctcgcattaaaaatcttactaaagtttccatcaataccatattttatttccctttatatgntggcttctccatgtaaagaatattaaatcaagttttttgagatgtctggt

SEQ ID NO: 826 - DNA, 478 bp, Ctenocephalides felis
  misc_feature (12)..(12): n = unknown
  misc_feature (34)..(34): n = unknown
  misc_feature (52)..(52): n = unknown
  misc_feature (85)..(85): n = unknown
  misc_feature (98)..(98): n = unknown
  misc_feature (162)..(162): n = unknown
  misc_feature (448)..(448): n = unknown
  misc_feature (454)..(454): n = unknown
tcctaagctctnggagttgatccctttcgaccgncgcccggccagtccaatncagggggtgttggaacccactggtggatggggngattgaaatgccnggagtgcaaaggtaacctttgtaatgtcgatgttttcccagaaatcgcagggtttgcaacgctnaagatgatgccaaggaagtttgtctcaagccacaagatacttgtttgagtattttaaatgcacaaggtgatgccataaaattagggtgcaccagcaacctgttcaagaaccagaatctgaaaaaaatgtgcgagaaaaaaccagaacgttgccaacttgtgacaaaaacgaatgcaatggtgatgccaaaaaacacgaatgtgtttcttgtgatgaaaatgatgaaaattgcttgacgacccttgaaaaagtcgagacgaagacccaatgcatgggccaatgctcnttaatnttgacggagataaagtgaaaagag

SEQ ID NO: 827 - DNA, 500 bp, Ctenocephalides felis
  misc_feature (50)..(50): n = unknown
  misc_feature (60)..(60): n = unknown
  misc_feature (121)..(121): n = unknown
  misc_feature (254)..(254): n = unknown
  misc_feature (302)..(302): n = unknown
  misc_feature (378)..(378): n = unknown
  misc_feature (439)..(439): n = unknown
  misc_feature (450)..(450): n = unknown
  misc_feature (475)..(475): n = unknown
ccatggaatagtggctacccaaaccaagataaaccaaatctcggcgtcgncccacatcangaacggggttagaaatcatttcactgggcccccccgatgggctggcattcatgggcaatgnggtgctctatcttcacttctgggatatttccatcgcaattatcaaagggctttgaaaaacagatgtagatgttagtgaaccaagaaaagccgctgttataaaaacaataaaccaactgggaagtaaatgctgnaattagtcttccgggacgattgtgatgagacttaagtaaaatactggncttcttccaatcctatctcctaattgccaaaaataaatgtgcctatgacttcgcccgcacgtccaatagcaaatgnattagttacatagaggtctctatcacaaacccagcttgatcttgacggagccgtgataaanaccatgtctgncatattataaccatgctgccaaggnattattggcttcaatcttattggct

SEQ ID NO: 828 - DNA, 384 bp, Ctenocephalides felis
  misc_feature (39)..(39): n = unknown
  misc_feature (71)..(71): n = unknown
  misc_feature (141)..(141): n = unknown
  misc_feature (172)..(172): n = unknown
  misc_feature (208)..(208): n = unknown
  misc_feature (223)..(223): n = unknown
  misc_feature (226)..(226): n = unknown
  misc_feature (234)..(234): n = unknown
  misc_feature (296)..(296): n = unknown
  misc_feature (312)..(312): n = unknown
  misc_feature (328)..(329): n = unknown
  misc_feature (343)..(343): n = unknown
  misc_feature (368)..(368): n = unknown
  misc_feature (376)..(376): n = unknown
gggtcccggtgcattagttataaaagaattgggaattgngcatttcatgacgggtgcaatcagcttctgancgatttctttttaacgcatatttttagaatgaacatataccatagttaggggggcattcgaaaacctggnctttaccatctttggagaataaggatcttgngcagtctttcggatctggctgatatcctacaaccgngcatgtaggttctgncgncttacagntttcccaggttttggtgagcacatatcatctacacaaaatggagcatcggaatttgagtctntgcaatttgatggtgnaattgggggttcttgnncagcgcacactttnaaagagacaatcgtgaaaaatggtnccaactgnttattagt

SEQ ID NO: 829 - DNA, 500 bp, Ctenocephalides felis
  misc_feature (1)..(1): n = unknown
  misc_feature (149)..(149): n = unknown
  misc_feature (213)..(213): n = unknown
  misc_feature (295)..(295): n = unknown
  misc_feature (406)..(406): n = unknown
  misc_feature (412)..(412): n = unknown
  misc_feature (430)..(430): n = unknown
  misc_feature (488)..(488): n = unknown
  misc_feature (500)..(500): n = unknown
ncaatatttttaattcataataagtatatgattgaatcgccaagaagggttggcaagtcgatgtaaaatagaaccgatggtgaaaatcattaaaaatcatttccagcggaaataaaacaactcttaatggagaatgcaattagaggtgntaagagaaaaatccctcaggaaaaccagaaaaaggttaccgggatcatgagtttattttctagnttaccggttagctagaaatctcacttattgggctttgctggattggatggtcccgggcgtattttacattaattttgaacgngagccatatgggagggtaatcatttctcaactttttatatcaatcggcagtagaattaccagcatatctactagggccgttcttcagcgacagaataaggaagacgttggnctctgnagcttcttttggaattgntctgcaccatcttccttcttatatgcattggcaatggtgaatccctccagaaattggncccactggtagn

SEQ ID NO: 830 - DNA, 423 bp, Ctenocephalides felis
  misc_feature (15)..(15): n = unknown
  misc_feature (24)..(24): n = unknown
  misc_feature (38)..(38): n = unknown
  misc_feature (48)..(48): n = unknown
  misc_feature (218)..(218): n = unknown
  misc_feature (247)..(247): n = unknown
  misc_feature (347)..(347): n = unknown
  misc_feature (350)..(350): n = unknown
cctcggatttcaaanaaggtttcntatcggatttgganggtggcgggngcagcctctcttcacttttatcttccgcaaatatctaaagtagcaatttggcccatgccatttgggtctcgtctcgacttttttcaggggtcggtcaagggcaaattttcatcaattttcatcacaagaaacacaatccgtggttttttggcatcacccattgcattcgntttttgtcacaagttgggcacggtctggnttttctcgcacattttttcagatcttggtcttgacagggtgctggtgcacctaatttatggcatcaccttgtgcattaaaatactcaaacaagatcttgnggnttgagacaacttccttggcatcatctttagcgttgcaaccctgcgattcttgggaaacatcgacattacaaag

SEQ ID NO: 831 - DNA, 187 bp, Ctenocephalides felis
  misc_feature (20)..(20): n = unknown
  misc_feature (116)..(116): n = unknown
ttttttttttttttcctttnaaaaaaacaatttttatttgtcaaaaagctacataagctggaaccattagaccacaaataatatatcactagacatttttaggaagtttacagttngttatacaattcttaaactaatttagttatcagtaagttttaagcagtcggcacagtctttacggacttgt

SEQ ID NO: 832 - DNA, 254 bp, Ctenocephalides felis
  misc_feature (55)..(55): n = unknown
  misc_feature (72)..(72): n = unknown
  misc_feature (76)..(76): n = unknown
  misc_feature (93)..(93): n = unknown
  misc_feature (137)..(137): n = unknown
  misc_feature (202)..(202): n = unknown
gcaataaatataattttattatataagaaacatatgtataacaatacaaattatnactatttaacagtcttnttgngataatttcttgacggnccgtatctgtagactttgatacaccttttttcggtaagctccanaacacctgatccctgccgaatacgtgagcttcagttagcgtttccgggaacttttggtgtaaagnttccggcaagaacattccggaagtcgcgcccaccatcatcattacggaaagt

SEQ ID NO: 833 - DNA, 329 bp, Ctenocephalides felis
  misc_feature (2)..(2): n = unknown
  misc_feature (31)..(31): n = unknown
  misc_feature (38)..(38): n = unknown
  misc_feature (86)..(86): n = unknown
  misc_feature (175)..(175): n = unknown
  misc_feature (309)..(309): n = unknown
cnaaaaatctcttcaaggtaacctttccgantattatntaatttttttgtaaattacaagttctttactcgatgtcacctcactgnacatatgaaacaaagatgtggcgctctttataaatttatcactaccttatctataatcatatcacctcacataaatttcataccatggntgtatttacaaaattcagacagtagttgacagagatgtattcgaaatttgaatcattaaacaaaaatattttgataaaattgatatgtctctccttaaaaaaaattgaatttctcatttataattatttcttgntctgggcatatgtaataagt

SEQ ID NO: 834 - DNA, 430 bp, Ctenocephalides felis
  misc_feature (22)..(22): n = unknown
  misc_feature (64)..(64): n = unknown
  misc_feature (393)..(393): n = unknown
gcatcgaaaacaaattcaatgntgaatccaaaaggaacttccaaatatgggtaacgttcgaggntaacttgaaaaaggattttgtgtatttgaagagtgctggtttggggtatataacagattcccgaagggatgatgtcttttaataaacagccaaatgaattttcacaatggattttacaaaaatgttgaattttgtgaaaaaagtggtattaaaactgtatggagccggagaagtgcaaagaagttttgaaggagagaattgagaaaatattttttttcctctaatatgatttaaataataaatttatttatgataataaatctaaaattagcatatgacatatcgtatgaaactttgaattagtaattaacgacatttggtatgtttgngtattttaataaaattttatattccgtaaaaaaaaaa

SEQ ID NO: 835 - DNA, 447 bp, Ctenocephalides felis
  misc_feature (321)..(321): n = unknown
  misc_feature (324)..(324): n = unknown
  misc_feature (418)..(418): n = unknown
  misc_feature (420)..(420): n = unknown
tattgatattaaatatgtattatttttatatatgtaaacgaattataatttttgctctttgattacttctactctggtgcattaacttttattcaactagattaaatttttggtttacttcctatgcctcacatcagtgtccttcatgtgatcaggagtattttttcgatctggactttgatctgtatcactctcctccatttcagctttgttgcgtttcttttcataaatgagaataatcgcgcataaaattattacttcagcacagatacccaaaaatggccacaaagcagctaatttatcttgaactcgaaccaaggntgnagaattaacagtaattccaatgccttgattagtagcaatacatgtatattctcctcgacgctttttcagccaaacaatttccaaagcagaattngnatatggcatgactaacaatttgatcga

SEQ ID NO: 836 - DNA, 137 bp, Ctenocephalides felis
  misc_feature (12)..(12): n = unknown
  misc_feature (16)..(16): n = unknown
  misc_feature (53)..(53): n = unknown
tttttttttggnttanacaaaattttttcatggattaaaaaaaactaaattgnaaaaatcttaaatgccttatcatatttgcgagcctgtgttcaaccataatatttttttatataacacataaagtaaaacaaagt

SEQ ID NO: 837 - DNA, 417 bp, Ctenocephalides felis
  misc_feature (5)..(5): n = unknown
  misc_feature (69)..(69): n = unknown
  misc_feature (217)..(217): n = unknown
  misc_feature (250)..(250): n = unknown
  misc_feature (292)..(292): n = unknown
  misc_feature (358)..(358): n = unknown
  misc_feature (384)..(384): n = unknown
  misc_feature (391)..(391): n = unknown
  misc_feature (400)..(400): n = unknown
  misc_feature (407)..(407): n = unknown
gccgntatttatattatattggttatacagaaagcactgttgtatgaaaagtatggggaatcaacacanggtgatgtaaggttactttattgtaaaagttattttatatgtaatttttaataacattaaaattattttgttctttctgttagatgaattgtgtgttagatcttgtgctgtgatttacatacaatttaatacagattgaaatgcaatntataaaagcattatttcaataatcattatatantaattttgattttgactatttgcagataaattcattacattntaaaatgtttactttattaagctatacaaaccttgaactttacactttgtattttctagaacatangtattaaataaattgttaaaaatatntgggggntagattttnctattgntaattggcgt

SEQ ID NO: 838 - DNA, 220 bp, Ctenocephalides felis
ttataatctgattctcgatttggatcttcataactggttctcagatatccattaccggaatgttcatcattacgtctgagttgtccactaaattcaactttttttccattttcttccatgacatgtctgaattttattttaccatcaactaaagattccatgtgagctcttgcgcaagttccatctcgttcaaaatgattttggtatctatattgttcgt

SEQ ID NO: 839 - DNA, 424 bp, Ctenocephalides felis
  misc_feature (35)..(35): n = unknown
  misc_feature (41)..(41): n = unknown
  misc_feature (45)..(45): n = unknown
  misc_feature (47)..(47): n = unknown
  misc_feature (114)..(114): n = unknown
  misc_feature (126)..(126): n = unknown
  misc_feature (222)..(222): n = unknown
  misc_feature (250)..(250): n = unknown
  misc_feature (341)..(341): n = unknown
  misc_feature (386)..(386): n = unknown
  misc_feature (424)..(424): n = unknown
tttttttttttttttttttttttttggggtccttnttttantttnanattgggcccctaataggattatcctggaaaaaaaaaaaaaggcggtttattaaaaggtggcagcagntaaaaaaaaagntggataaaaaaaaggggaaaatcattgctaatgatgcaactcataattattaaggaaattggctataacaactactacattatcagatctatccgnccttcttaatattcaataatattatggntatcaggccccttatcactttatagatttttaattaatctatttaatattaaataaaaaataaatttaaaaccattaaaccgatacattgnctttaaatgaaataaatcaccataacctttattaagcttgggtgnaatatgcaatagcaatttcatatacacactcactaggn

SEQ ID NO: 840 - DNA, 221 bp, Ctenocephalides felis
tatataatctgattctcgatttggatcttcataactgattctcagatatccattaccggaatgttcatcattacgtctgagttgtccactaaattcaactttttttccattttcttccatgacatgtctgaattttattttaccatcaactaaagattccatgtgagctcttgcgcaagttccatctcgttcaaaatgattttggtatctatattgttcgt

SEQ ID NO: 841 - DNA, 359 bp, Ctenocephalides felis
  misc_feature (13)..(13): n = unknown
  misc_feature (272)..(272): n = unknown
  misc_feature (285)..(285): n = unknown
  misc_feature (291)..(291): n = unknown
  misc_feature (314)..(314): n = unknown
  misc_feature (340)..(340): n = unknown
aacaacaaatggnaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgtattttatgtnaggagcacaaacnaaatgncattactataggaattctgattntttaaaaatataaatatagaactttntgaaattcatgttcttttt

SEQ ID NO: 842 - DNA, 319 bp, Ctenocephalides felis
  misc_feature (96)..(96): n = unknown
  misc_feature (124)..(124): n = unknown
accttggtttacctttatggggtatattaaaaaaatattatgggtgaacccaggctccccaaatatgataaggggtttaagaattttacaatttanaattttttaaatccatgaatatatttgntctaatcaaaattattcattttacgcttaattttattggttgaactaatagatagatagataaagatatagagttaatataaaaatgaagaaaataaaattaaaagtaagaaataatacggacttctaaatgtagggggaagtcccctagtggcggacacctaaagttatttataaataaatcaaaaaatatttt

SEQ ID NO: 843 - DNA, 126 bp, Ctenocephalides felis
  misc_feature (5)..(5): n = unknown
  misc_feature (18)..(18): n = unknown
  misc_feature (63)..(63): n = unknown
  misc_feature (90)..(90): n = unknown
  misc_feature (118)..(118): n = unknown
cttantggtttatattanctttcttattactaatcaataaaactataaaatatgtaatactgncatttactttacaagaacctagcaggntagttaaaaattttctttactataagangttggtgt

SEQ ID NO: 844 - DNA, 475 bp, Ctenocephalides felis
  misc_feature (71)..(71): n = unknown
  misc_feature (74)..(74): n = unknown
  misc_feature (406)..(406): n = unknown
  misc_feature (458)..(458): n = unknown
cgaaccggggttggcaattttggtcatttggccccaagccttaaaatttggatgggggtcccgggtgccantangggtttattaaaaaggaattgggggaatttggtgccatttcatggacgggtgcaaatcagcttctggaccgaatttcttttttacacatattttttagaatggaatcatattaccataagttagggtggggcattcgaaaacctgacctttaccatctttgcagaataaagtatcttgtgcagtctttcggatctggctgatatcctacaaccgcgcatgtagtttctgccgccttacaagttttccccaggttttgatgaagcacatatcatctacacaaaatgggagcatcggaatttgagtctctgcaattgattgttgtaattggggnttcttgtccagccgcacaacttcaaaagtagaacaatcgtgacaaaatggtnccaactgcttattaata

SEQ ID NO: 845 - DNA, 437 bp, Ctenocephalides felis
  misc_feature (14)..(14): n = unknown
  misc_feature (21)..(21): n = unknown
  misc_feature (33)..(33): n = unknown
  misc_feature (37)..(37): n = unknown
  misc_feature (69)..(69): n = unknown
  misc_feature (77)..(77): n = unknown
  misc_feature (112)..(112): n = unknown
  misc_feature (337)..(337): n = unknown
  misc_feature (351)..(351): n = unknown
ccagggggctttgnttaccgnaatggacaaccnttcnaaattccaaaaagaaatttactattggaatgnttaaatgnaatagattaatcaaattttagatgattaaaattgntctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgntaacattttattgntgaatggataaaagataaatacaattttataagctggttggataaattaattttgaataatccttatcatagattggttaggtgcc

SEQ ID NO: 846 - DNA, 443 bp, Ctenocephalides felis
  misc_feature (24)..(24): n = unknown
  misc_feature (41)..(41): n = unknown
  misc_feature (69)..(69): n = unknown
  misc_feature (79)..(79): n = unknown
  misc_feature (115)..(115): n = unknown
  misc_feature (167)..(167): n = unknown
  misc_feature (169)..(169): n = unknown
  misc_feature (229)..(229): n = unknown
  misc_feature (232)..(232): n = unknown
  misc_feature (241)..(241): n = unknown
  misc_feature (288)..(288): n = unknown
  misc_feature (290)..(290): n = unknown
  misc_feature (347)..(347): n = unknown
ttttttttttttttttaatttcanaaagcttctatttttanatattttaaataatcagaaattaccttnggtaatggcnttttggttgggccccttacataaaaaacaattttanacattttaatttttatacatattttttatatttaattgcacagaacatttgngnatttattatattaattgactactttatgataatttgaatcctaattagtctattcaagantgntttcctggnttaagccttacttagcaatctcacttttgcattcttcgccgggtggngngggtatgcatcgcaactccgtttatcaaagtgcaagccatttggacaatcataatgntttatttgccatttggtggtaaccaagaaacattgataatattttttacaatctcttcgaaccggaaaaacgtttcacttttggatgcagtcttgc

SEQ ID NO: 847 - DNA, 454 bp, Ctenocephalides felis
  misc_feature (321)..(321): n = unknown
  misc_feature (324)..(324): n = unknown
  misc_feature (412)..(412): n = unknown
tattgatattaaatatgtattatttttatatatgtaaacgaattataatttttgctctttgattacttctactctggtgcattaacttttattcaactagattaaatttttggtttacttcctatgcctcacatcagtgtccttcatgtgatcaggagtattttttcgatctggactttgatctgtatcactctcctccatttcagctttgttgcgtttcttttcataaatgagaataatcgcgcataaaattattacttcagcacagatacccaaaaatggccacaaagcagctaatttatcttgaactcgaaccaaggntgnagaattaacagtaattcccatgccttgattagtagcaatacatgtatattctcctcgacgctttttcagccaaacaattccaaagcanaattgggatatggcatgatctaccaattggattcgatcggat

SEQ ID NO: 848 - DNA, 500 bp, Ctenocephalides felis
  misc_feature (13)..(13): n = unknown
  misc_feature (98)..(98): n = unknown
  misc_feature (157)..(157): n = unknown
  misc_feature (476)..(476): n = unknown
  misc_feature (481)..(481): n = unknown
ccaatttattggntttatatacagataaaaattggtatcaagttagataacaaaatataaaatttaaaaatcaaaacatatttataaatttttttggncttatttctagaatttattcagcattagaaacattttgaataattttcttgaatattgngatacctcgaaggaaagtttctgtatctaaatattcatcatggtcatgcagcaatactggcgtgttattcatgggagaaaaaccaaaagccggcagtccaatttctcttatatatctgctatctgttgcagctggaaaaacttgtggttcaagaacaagtcccatttcatcagtagctcttttaaatgctgccaaattttattgctttcattcagttcagggttgctatcagtgggtctttttggtcaaatctattcacatccttgccagcttctttgaccatttcgatctttcttccaattccttgggggctaagganggggnaaacgttatcaaaaactgc

SEQ ID NO: 849 - DNA, 293 bp, Ctenocephalides felis
aaattataagatacccggaaacatttaaataaacgatatatgaatatttaatacatcataaaaaagaatttattaaattaaaagaaaatggcgatctactcaatttatctaaaatagtttttaggtgtaagaagattagaactaattctatttgtttactacttttgttactcgtatttaattttgatttaaattatgtatgttattttagaaagcactgataagtataaggaattgttgaactgtattttataagactgctaggcaaatcacgtttatttataaaaaaatgt

SEQ ID NO: 850 - DNA, 320 bp, Ctenocephalides felis
  misc_feature (27)..(27): n = unknown
ttaggtaacttttttttaaggccgtcntgtgctggaattcggcttagcgtggtcgcggcccgaggactttgttttactttatgtgttatataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaagatatagagttaatataaaaatgaagaaaataaaattaaaaaaaaaaaaaaaaaaaaaaaaaaaaaaaaa

SEQ ID NO: 851 - DNA, 141 bp, Ctenocephalides felis
  misc_feature (73)..(73): n = unknown
tcctttttgcattgtaggatcaatgggatcgcgaaatagtccaactttttggacaaaatgaatgggttgctgncaaaatacgaacgcttgctggaatttgtttcaactgggaattagttcttgagactccaaagacaatgt

SEQ ID NO: 852 - DNA, 423 bp, Ctenocephalides felis
  misc_feature (45)..(45): n = unknown
  misc_feature (49)..(49): n = unknown
  misc_feature (128)..(128): n = unknown
  misc_feature (150)..(150): n = unknown
  misc_feature (239)..(239): n = unknown
ttttttttttttttttttttttttttagaataaataaagcatttnttgnttttttcccagcataaataaaatttcttaacttaatagcgcaagaagcatattgtataaaaaaagcttttgttaaaggncttatttttattttcatattgngccctaataagatttatacttaaaacaataaaaaatgcgttttattaaaagttgcaagcagttaaataaaatgttgaataaataatagngataaatcattgcataatgatgcaactcataattattaagtaaattggctataacaactactacattatcagatctatccgtcacttcttaatattcaataatattatggatatcaggcctcttatcactttatagatttttaattaatctatttaatattaaataaaaaataaattttaaacc

SEQ ID NO: 853 - DNA, 500 bp, Ctenocephalides felis
  misc_feature (49)..(49): n = unknown
  misc_feature (86)..(86): n = unknown
  misc_feature (200)..(200): n = unknown
  misc_feature (222)..(222): n = unknown
  misc_feature (230)..(230): n = unknown
  misc_feature (336)..(336): n = unknown
  misc_feature (367)..(367): n = unknown
  misc_feature (374)..(374): n = unknown
  misc_feature (478)..(478): n = unknown
  misc_feature (490)..(490): n = unknown
cctatgccaggggaatataaaaattcttggtaaaggcatttttggtggncaaaaccttaaaaaatcattttaaaaccttatattgnttccaaatttaaaaatattaagctgatattcaaagaagttggaattgaaagctaacaagtttatttttctgtgatcatttggattcaagttatattatttctatttgtgattgnctataaaaacaatgaatattgnttcattgntccctgctaagtcattaatatttcactgtagttattaatttaagtttgattgacatccgttgattttttccacaagaagttaagtctttcttttttttattagtgnttaaataataccttttcgtgaagagaagggntgattgnatatttcatttgactaagaacctagctggtatgcttccaagaaagcccaacttaccaataaccttggaaaattatgaagaggattttttaagccagccttaagngatggaagaagngaaaattaat

SEQ ID NO: 854 - DNA, 495 bp, Ctenocephalides felis
  misc_feature (22)..(22): n = unknown
  misc_feature (431)..(431): n = unknown
  misc_feature (448)..(448): n = unknown
  misc_feature (450)..(450): n = unknown
ttttttttttttttttttatgngtatataatttatttaaaaataacaaaggtcaaaaataagttttatgtacaaaaaatcttctaatcagaaagtcattaattcgttacgtgtgagattaaaattttgaataaatttcgtagttgttgaatctattgggcattttgtttgatccagtccacataagcagagaccctggtgtaaactgatgggtatccaacaccaccgcaaggaatgtagccccaggacacaacacccaaaagtgtagcctcgcttccgttatattgtacaagtgggccacctgaatctccagagcaagcgctaactccaccagtcaagggtccagtgcacaagtttgttgggtgcaatggagtagatcctgctcctcctagagccttttcacattcggggtatggtccaatgggttttcanccaatcttgccttcaananaaccattggcacaaatcttatgctggaggcgtaaatccttatgac

SEQ ID NO: 855 - DNA, 480 bp, Ctenocephalides felis
  misc_feature (420)..(420): n = unknown
  misc_feature (445)..(445): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgncattaactataggtaattctgattntttaaaatatataaatatagaagctttatgaaatt

SEQ ID NO: 856 - DNA, 313 bp, Ctenocephalides felis
  misc_feature (42)..(42): n = unknown
ccgggcgaaatcaagtgggtagacgaagcacaatggtgtggnttccagcagcaccaccagatgccaagtttcctgcgaagtaacgccagaattgggtcttcttgtcaaggtatcatcatctaccgtgcagcatactttggattctatgacaccgctcgtggaatgttgccagaccccaagaacaccccattagttatcagctgggccattgcacaagccgtcacaactgttgctggtattgtgtcatatccattcgacactgtccgtaggcgtatgatgatgcagtctggacgtgcaaagtctgaaatgttgt

SEQ ID NO: 857 - DNA, 415 bp, Ctenocephalides felis
  misc_feature (2)..(2): n = unknown
  misc_feature (98)..(98): n = unknown
  misc_feature (156)..(156): n = unknown
  misc_feature (180)..(180): n = unknown
  misc_feature (256)..(256): n = unknown
  misc_feature (391)..(391): n = unknown
  misc_feature (403)..(403): n = unknown
cnaaaaaataaagctttattggtttttcagcataaataaaggttcttacttaatagcgcaagaagcatattgtataaaaaaagcttttgtataaaggncttatttttattttcatattgggccctaataagatttatacttaaaacaataaaaaangcgttttattaaaagttgcaagcngttaaataaaatgttgaataaataatagggataaatcattgcataatgatgcactcataattattaagtaaattgnctataacaactactacattatcagatctatccgcacttcttaatattcaataatattatggatatcaggcctcttatcctttatagatttttaattaatctatttaatattaaataaaaaataaatttaaaaccntttaaccggtcnttggcctttaaa

SEQ ID NO: 858 - DNA, 145 bp, Ctenocephalides felis
  misc_feature (15)..(15): n = unknown
  misc_feature (104)..(104): n = unknown
cttcttggtgctatntactttctttgcaggtgcctctgaacgggcgtttatttaaatcatcgctttcttgattattatcctcacgctttcctgattggtatcgnctttatgcgtcaaagttgccaagatcgttgcattatttggt

SEQ ID NO: 859 - DNA, 174 bp, Ctenocephalides felis
ctttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggt

SEQ ID NO: 860 - DNA, 213 bp, Ctenocephalides felis
aaggtttcaaatgtcccgtcacccgtccgagattttatccaaatataaatgattgtcaaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgcttccgt

SEQ ID NO: 861 - DNA, 399 bp, Ctenocephalides felis
tttttgggcgggccaacgattattttattaaaaagaaacatgtaattgcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgtttatttgccatttggtggtaccaa

SEQ ID NO: 862 - DNA, 258 bp, Ctenocephalides felis
  misc_feature (21)..(21): n = unknown
aggcatttaagaattttacantctagattttttttaaatccatgaatatatttgttctaatcaaaattattcattttacgcttaattttattgggttgaactaatagatagatagataaagatatagagttaatataaaaatgaagaaaataaaattaaaagtaagaaataatacggacttctaaatgtagggggaagtcccctagtggcggacacctaaagttatttataaataaatcaaaaaatattttaaaaaac

SEQ ID NO: 863 - DNA, 445 bp, Ctenocephalides felis
  misc_feature (216)..(216): n = unknown
taccactttttcaggaacacacaacctaaattaaaaaagttgggaagagatgtatcaatcaattaaaagtttaatatcaaacgataatatgatgcaaagtggcgataatccttatatacatgcacaaataaaattcaccattataaaataatatagtgctatttttttacaattctaaaaataataaaatagtttcttatataaaaaacgatcggntgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgcctttaccatctttgcagaataagtatcttgtgcagctttcggatctggctgatatcctaca

SEQ ID NO: 864 - DNA, 485 bp, Ctenocephalides felis
  misc_feature (92)..(92): n = unknown
gttatatgaaattgctattgcatattacatacaagcttaataaaggttatggtgatttatttcatttaaaggcaatgtatcggtttaatggntttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgttttaagtataaatcttattagggcacaatatgaaaataaaaataagaactttatacaaaagctttttttatacaatatgcttcttgcgcttttaagttaagaaaattttatttatgcttgtaaaaaaacaataaagctttatttatc

SEQ ID NO: 865 - DNA, 500 bp, Ctenocephalides felis
  misc_feature (56)..(56): n = unknown
  misc_feature (81)..(81): n = unknown
  misc_feature (130)..(130): n = unknown
  misc_feature (419)..(419): n = unknown
  misc_feature (442)..(442): n = unknown
  misc_feature (469)..(469): n = unknown
ctggaatggtggaggccacctcaacgaatgggttggcccaaaatctttctcgtgcngaactgctgcaaaaggtgaaaacgntttttcccgatcgaagagattgtaaaaaatattatcaatgtttcttggntaacaacaaatggcaaataaaacattatgattgccaaatggcttgcactttgataaaacggagttgcgatgcataccccgcccccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtttttatgtaaggagcacaaaccaaatgncataactatagtaattctgattntttaaaaatataaatatagaagctttntgaaattcatgttctttttaataaaaataaa

SEQ ID NO: 866 - DNA, 226 bp, Ctenocephalides felis
  misc_feature (223)..(223): n = unknown
tagtgggtggcactgtagaatatcccacttttgatcagcgcacactttgatctggggctacagggattccttaacccgggatctgctcctatttccggacaatactgcatttcgggtgaactgcacgaattcacgcaactaaattttacttttttacatttttgctcgggtttcggtacaaaatgctatacagttacatgtcctgcacagcctaaggtgcttncgt

SEQ ID NO: 867 - DNA, 424 bp, Ctenocephalides felis
  misc_feature (6)..(6): n = unknown
  misc_feature (9)..(9): n = unknown
  misc_feature (16)..(16): n = unknown
  misc_feature (56)..(56): n = unknown
  misc_feature (72)..(72): n = unknown
  misc_feature (74)..(74): n = unknown
  misc_feature (161)..(161): n = unknown
  misc_feature (163)..(163): n = unknown
  misc_feature (170)..(170): n = unknown
  misc_feature (260)..(260): n = unknown
  misc_feature (334)..(334): n = unknown
  misc_feature (347)..(347): n = unknown
  misc_feature (367)..(367): n = unknown
  misc_feature (371)..(371): n = unknown
  misc_feature (386)..(386): n = unknown
  misc_feature (412)..(412): n = unknown
  misc_feature (421)..(421): n = unknown
aaaatnttnggtgggntaccgccgactcataaataattatttaaacaatggaatgntaaaaaaaattaaagntnggaaatataatatatgtattggattaacttagttaattctccctcgcaattttatactatagtaaccagaaacaaaaatcagagtgngnaaaatgnaaattcatatatttttggtaaaaatacaatcaagatataacagtgccacaatattattaaaatacgtatttgtgacgaaacctaaagtgnagtcagaatataaaaaacaataatatttatacctccaaatgtatgctttgaaaaaaagcattcgaagattttgnttaaatattttgntaagtcccatttatgtttgntcgntcaattaaattatgnttcttttgcaagtaagaatatggtgnagatattgnccc

SEQ ID NO: 868 - DNA, 369 bp, Ctenocephalides felis
tctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 869 - DNA, 380 bp, Ctenocephalides felis
  misc_feature (9)..(9): n = unknown
  misc_feature (51)..(51): n = unknown
  misc_feature (61)..(61): n = unknown
  misc_feature (63)..(63): n = unknown
  misc_feature (120)..(120): n = unknown
  misc_feature (128)..(128): n = unknown
ctgaaatgnggagacgacgtcaacgaatgggttgcccaaaatctttctcgngcagaactgngngcaaaagtgaaaacgttttttcccgatcgaagagattggaaaaaatattatcaatgnttcttggntaacaacaaatggcaaataaaacattatgattgccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatg

SEQ ID NO: 870 - DNA, 469 bp, Ctenocephalides felis
  misc_feature (25)..(25): n = unknown
  misc_feature (30)..(30): n = unknown
  misc_feature (50)..(50): n = unknown
tgaagccttggggttgaatcccttncgggnccggcgagtctaaaatctgnggagaagaagtgtcattgcgatcaaaaccaacacagcccttgataaataatgtatttttcaacacattcaaaattaaaatactatgagaaccaattcaaactgtttaaacaagtttgacaaagttgtgccgttgataatcctagttgatgtattgtctattaaaatcctgacacttcaagcattgtttatgaatatattgatcaagaatacaaggtttttaagttctctctggaatattttttgttcttccagagatgtttaattgacagttgcaatcaattgggtttttcatagacatacattgtaacagtatgcttgttttaataaaatcaatcaaattaataaatatccatgattaagatttatatgaattaacatttttattaagtttttatttatataaatttactggaaactt

SEQ ID NO: 871 - DNA, 462 bp, Ctenocephalides felis
  misc_feature (11)..(11): n = unknown
  misc_feature (16)..(16): n = unknown
  misc_feature (25)..(25): n = unknown
  misc_feature (63)..(63): n = unknown
atacttaagcncttgngagctccantcgcttacgtggtcgcggcgcgggggtacacacaattngcaattggaaaatctagccacaaattttttaacaatttatttaatacttatgttctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattcatataaaataacttttacaataaagtaaccttacatgagatgtgttgatttcagatcttttcatacaacagtgctttctgtataaacaatataatataaatacgg

SEQ ID NO: 872 - DNA, 389 bp, Ctenocephalides felis
cccaagtttcacagcaggtttggcagtcactataatagtatgctccctttcattttctcctgaaccaactttgcatgtgtaagagccagcatcatcttgttcagttttttcaataatgaattgatgttcttcctttattaattggtaacggtccttgagatcattgatttcttctacttttttctcatctttaaaccactgatcaacaggaccatctttcaatggacaggttagaaccaatggactgcgaatatcaaaaagtttttgcgacgtggcttcaccttctctggcataaacactgctttggaccaaaaataataaaattgcctacacaaaaactgcttcatatttattgaattttcttccctcgattggaatagttcataagt

SEQ ID NO: 873 - DNA, 231 bp, Ctenocephalides felis
  misc_feature (14)..(14): n = unknown
  misc_feature (35)..(35): n = unknown
  misc_feature (184)..(184): n = unknown
  misc_feature (190)..(191): n = unknown
  misc_feature (201)..(201): n = unknown
  misc_feature (206)..(208): n = unknown
aatattgttaaagntaaatatataaagattgggtnttatgggttatatgtctaacatttattttgtaacatacagttaagaacacaatagaaaaatcatttaattagttggatatttttagtataagtattcctgtgtagatagcaagttgtgactacagaataaatatctgattttatcacanggtggnnaaaaaaaaanaaaannnaaaaaaaaaaaaaaaaaaaaaaa

SEQ ID NO: 874 - DNA, 431 bp, Ctenocephalides felis
gggtagttcttggaaaatttcttgacttccctgtgatacatttcctgagcccgtgaacacgaacgtcaatggacctacagattttggcatcatacctaaagcgatttcatatccagcatcccctatggattgtctggccatggaggaatttctgtaattgtgagccaatccaatatgcatgaaaggtgtatgatgacccaaagctaaaagacgtaaacctaatccgtgcaaaatattgatcataccggcaacaccagcatattttccaaatgctactactctttggcccttttcgtccatcaacttttcataatcgataagacgaatattcttttccataattgcatcaagtaaaggcatattagattcttgggctttgataacatgtgaaaacatgcagtagggtttattgggaattaattgtctacagg

SEQ ID NO: 875 - DNA, 432 bp, Ctenocephalides felis
  misc_feature (68)..(68): n = unknown
  misc_feature (192)..(192): n = unknown
gggctcattggaagcaaaaattatggatcgttaatagcaatttttttaagctcattcataaatactgnataattatttcattttttatcgttttttattattgaaatgcccacaacaagtatacattcaaaatcaaactatatggtattagtagtatataaataattatttacttctactaattaatattgncgaattcatattctatttccatccctatcccttttttataaatcgtgtttcaataatttacctcaaaatgagatctaaaatatgaagaaatgatatacaatttcatctatacttatattttaaaagtgcacaattaataataaaaagattattttactctcgttcttgagaattgagatttggctttggcaatacacgtacaatattctgacctttcatagcttttaatataagtaaaag

SEQ ID NO: 876 - DNA, 418 bp, Ctenocephalides felis
  misc_feature (30)..(30): n = unknown
  misc_feature (259)..(259): n = unknown
  misc_feature (328)..(328): n = unknown
  misc_feature (331)..(331): n = unknown
  misc_feature (353)..(353): n = unknown
gaaaacgttttttccgatcgaagagattgnaaaaaatattatcaatgtttcttggttaacaacaaatggcaaataaaacattatgattgccaaatggcttgcactttgataaaacggagttgcgatgcatacccacgcccccggcgaagaatgcaaaagtgagattgctaagtaaggcttaaaccaggaaaacaatcttgaatagactaattaggattcaaattatcataaagtagtcaattaatataataaatacacnaatgatctgtgcaattaaatataaaaaatatgtataaaattaaaatgtataaattgtttttatgtaagngcncaaccaaatgcattactatagnatttctggttttttaaatatttaattttgagccttttgaatcaaaaaaaaaaaaaaaaaaaaaaa

SEQ ID NO: 877 - DNA, 283 bp, Ctenocephalides felis
aagcaaactgaatttgatctgaggtaaaactgaattcaagacataaaagcatcaccaagtatgtatagataaaagataaagattgtaaaaagtttgagaaacactgtttggatggtgaaacaaaatatagaaaacacaaaagttaaaaaatatatatactcagccccaaataatataatttaaagttatggttaagtttgtttagtagctcagtggtaatagcattagccttgcaaccagaattgcagattccattccctcattaaacctgatatcaagcagt

SEQ ID NO: 878 - DNA, 369 bp, Ctenocephalides felis
  misc_feature (55)..(55): n = unknown
tttttttactcggatctatacaataagagtttatttctgcgagtttagaaatggntcagtagcaacttctgaattttctttgtaatcgataatactttctcaaagtataattgcatttcacaacacacgacggaaatatggttatggccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgctttcaacaacacttcctaatcgacccatcattaaagatatacatactgccattgcctgagttgtgtagggt

SEQ ID NO: 879 - DNA, 500 bp, Ctenocephalides felis
  misc_feature (469)..(469): n = unknown
taagggtttcaatttacctcactgcaagtgttggatttaagcgagtgccagttttctcttatagatgctgatatgttcagaggaattggatctcttagcagtttgaatctcagtagtaatggaatagtagaaatctatccaagagctttcgataatttgattgacttgagatttattgacttgacacataatctacttactttcttacctgacaacgtcttccaaaataatgatcatttggatgttattaaaatttctaacaacccgaatctcatgaatttgcctagatttcattcaaatttgtcatcgtttaccacttatatgtttgaagcagtaaattgcggattacttagcttagacaaacatacatttgctgaaatgccttccatggctcaactgaatttagctcagaactcgatcaaagatttaaaatataatattttctggcatatgcgccaattaatcagcntaaatttggggtaatataaaatcaccaacct

SEQ ID NO: 880 - DNA, 440 bp, Ctenocephalides felis
  misc_feature (37)..(37): n = unknown
  misc_feature (85)..(85): n = unknown
  misc_feature (221)..(221): n = unknown
ccttttgccatttaaactctttggtccattccgttgntaaaaatacttaagacatttctatttctttcgggataaattatatagnggtacaaaatgggaaacaaatcttcacttctactaagagaggaagaaattgcaagaattcaagatgaaactggcttcactccaaatcaaattgagcgtttgtctcaagattcacatctctagatcgtggagactgnggaactctttcacgagatgattttttgagaatacccgaactcgcaataaatccttaggtgataggattgccatgcattttttgctcaaagtcatgatgacagggtgaatttcttacagtttatgcaagtcttagcacatttcagacccattaagaagaatcgggaaaataaattgacagcagggaagaaaaattgagaattgcttcaaatgtatgcttg

SEQ ID NO: 881 - DNA, 286 bp, Ctenocephalides felis
  misc_feature (43)..(43): n = unknown
aattagctgggttcgtgccctgggccaattgtaaatggccaanggggctatgccactcttgtcaatggtggagttggctggaaaaaagtaactttactcctatcttctcagactggcaaaggatttaacttcttaattgaaatttggggatattagattagaaatataatgaaaatgtgaatatagaaaaaaaattaaatatacaatagtattttaaatttggcacacatctatctatgcatccataaataaagggtatatacagcattcatttaaaaaaaaaaaa

SEQ ID NO: 882 - DNA, 420 bp, Ctenocephalides felis
  misc_feature (10)..(10): n = unknown
  misc_feature (71)..(71): n = unknown
  misc_feature (343)..(343): n = unknown
taaaattggntgggtcccgggtggcattaaggttattaaaaagaaatggggaattttggtgccattttcantgaacgggtgcaaatcagctttcttggacgaatttctttttacacatattttttagaatggatcatataccataagttagggtgggcattcgaaaaacctgacctttaccatctttgcagaataagtatcttgtgcagtctttcggatctggctgatatcctacaaccgcgcatgtagtttctgccgcttacagttttccccaggttttgatgagcacatatcatctacacaaaatgggagcatcggaatttgagtctctgcaattgattgntgtaattgggggtttcttgccagcgcacaacttcaaagtagaacaatcgtgacaaaatgttccaactgcttattagt

SEQ ID NO: 883 - DNA, 382 bp, Ctenocephalides felis
cacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttattagattcgatgtaagatatatgt

SEQ ID NO: 884 - DNA, 363 bp, Ctenocephalides felis
  misc_feature (40)..(40): n = unknown
  misc_feature (54)..(54): n = unknown
  misc_feature (57)..(57): n = unknown
  misc_feature (337)..(337): n = unknown
  misc_feature (357)..(357): n = unknown
cggatggatatctttaatgatggggcgattaggaagtggnggtggaagcaatgntgnaggaataattctagattataattgcgatttaacatttttaatatcaggaacatctctgatagcatgtggagtgattgcattctttatacccgaacatttatcagaagcaagtggatagaagaacgagcattgcttcatatggaccataaccatatttccgtcgtggttgtgaaatgcaattatactttgagaaagtattatcaattacaaagaaaattcagaagttgctactgaatcattttctaaaacatcgacatgaaaattaataactctttattgntattagattcgatgtaaganatatgt

SEQ ID NO: 885 - DNA, 349 bp, Ctenocephalides felis
tttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaacattctaataaat

SEQ ID NO: 886 - DNA, 371 bp, Ctenocephalides felis
  misc_feature (18)..(18): n = unknown
  misc_feature (23)..(23): n = unknown
  misc_feature (44)..(44): n = unknown
  misc_feature (73)..(73): n = unknown
  misc_feature (149)..(149): n = unknown
  misc_feature (166)..(166): n = unknown
  misc_feature (186)..(186): n = unknown
  misc_feature (189)..(189): n = unknown
  misc_feature (210)..(210): n = unknown
  misc_feature (249)..(249): n = unknown
actcaagggcatggcggntggtntttctttatggaggggccganttaggaggggtggtgggagccaaggtggngggaaaaatctagaatattattggcgaattaacaattttaatatcaaggaaccatctctgatagcatggtgggagnggatggcttcttttttnccgacatttatcaaaaagcnagngggtagaaaaacgagcattgnttcatatggaccataaccatatttcccgtcgtgtggtgngaaatgcaattatactttgagaaaggattatcaattaccaagaaaattcagaaggtgctactggatcatttctaaaacatcgaatgaaaaataataactctttattggtattagattcgatg

SEQ ID NO: 887 - DNA, 360 bp, Ctenocephalides felis
  misc_feature (53)..(53): n = unknown
  misc_feature (349)..(349): n = unknown
gccccagagcccttagggcccgcaattattgacggtaaccgggatcatatgcnaaaattgcggggcaataatattgggttcctatactattttcgtcacaataataatagctttgacaatcatttatatttggataaaatctcgatgggtgacggacatttgaaaccttgtactttgcagactgtctttctttagtggtgcactgtagatatccactttgatcagcgcacacttgatctgggctacaggattccttaaccggatctgctctatttccggacaatactgcatttcgggtgaactgcacgaattcacgcaactaaattttacttttttacatttttgctcnggtttcggaca

SEQ ID NO: 888 - DNA, 241 bp, Ctenocephalides felis
gggcgccgacttcccggaatggtctttgccgggaaacttttcacccaagaagttaccggaaacgcctaactgaagctcacgtattcggcagggatcaggtgttctggagcttacccgaaaaaaggtgtatcaaagtctacagatacggcccgtcaagaaattatcacaagaagactgttaaatagttataatttgtattgttatacatatgtttcttatataataaaattatatttattgt

SEQ ID NO: 889 - DNA, 328 bp, Ctenocephalides felis
  misc_feature (40)..(40): n = unknown
  misc_feature (57)..(57): n = unknown
  misc_feature (71)..(71): n = unknown
  misc_feature (267)..(267): n = unknown
atccctttgatcagcgcacacttgatctgggctacagggntccttaaccggatctgntcctatttcccganaatactggatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggnaacgacagataacgccacaaaactaataaaaaccaatgtgatataaaacattctaataaat

SEQ ID NO: 890 - DNA, 496 bp, Ctenocephalides felis
  misc_feature (209)..(209): n = unknown
  misc_feature (211)..(211): n = unknown
  misc_feature (455)..(455): n = unknown
  misc_feature (488)..(488): n = unknown
tttttttttttttttttttagcggcccaaacgatttatttttattaaaaagagcatgtaatttcataaagcttctatatttatatattttaaataatcagaaattactatagttaatgacattttgtttgtgctccttacataaaatacaattttatacattttaatttttatacatattttttatatttaattgcacagatcatttgngnatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttggtaaccaagaaacattgataatattttttacaatctcttcgatcggnaaaaacgtttcactttttcatgcagttttcccnaaaaaaat

SEQ ID NO: 891 - DNA, 305 bp, Ctenocephalides felis
  misc_feature (279)..(279): n = unknown
aggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgcatgaaaattaataactctttattgntattagattcgatgtaagatatatgt

SEQ ID NO: 892 - DNA, 455 bp, Ctenocephalides felis
  misc_feature (27)..(27): n = unknown
  misc_feature (238)..(238): n = unknown
  misc_feature (354)..(354): n = unknown
tttttttttttttttttttttttattncataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgntttatttgccatttgttgttaaccaagaaacattgataatattttttacaatctcttcgatcggaaaaaacgttttcacttttgcatgcaggtctgcacga

SEQ ID NO: 893 - DNA, 283 bp, Ctenocephalides felis
  misc_feature (169)..(169): n = unknown
gggaagtggaacttttgaaggatgggatttgatttctgccccaaaataccaagaaccaggattggagaaatatgctctgatttattcccctctactttacccccagttgaacaaagcgttaagaagatgcaaaggtagacaaaggagccatacatgatggtgtattggngggagggtccacaagaatacctaaaattcgatctctgctacaaagaattctttgcaggaaagaccttaaattcttccataaatccagatgaactgtggcttatggtgctgcagt

SEQ ID NO: 894 - DNA, 500 bp, Ctenocephalides felis
  misc_feature (29)..(29): n = unknown
  misc_feature (420)..(420): n = unknown
  misc_feature (443)..(443): n = unknown
  misc_feature (473)..(473): n = unknown
atgtggaagaccgacgtcaaccgaatggnttgaccccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgncattaactatagtaatttctgantatttaaaatatataaatatagaagccttntgaatcaaaaaaaaaaaaaaaaaaaaa

SEQ ID NO: 895 - DNA, 333 bp, Ctenocephalides felis
  misc_feature (8)..(8): n = unknown
  misc_feature (71)..(71): n = unknown
  misc_feature (261)..(261): n = unknown
atgacggngcaatcagcttctgacgatttctttttacacatatttttagaatgatcatatcatagttaggngggcattcgaaaacctgacctttaccatctttgcagaataaagtatcttgtgcagctttcggatctggctgatatcctacaacccgcgcatgtagtttctgccgcttacagtttttcccaggttttgatgagcacatatcatctaccaaaatggagcatcggaatttgagtctctgcaattgattggtgnaaatgggggttcttgtcagcgcacaacttcaagtagaacaatcgtgacaaaatgttccaactgcttattagt

SEQ ID NO: 896 - DNA, 340 bp, Ctenocephalides felis
  misc_feature (259)..(259): n = unknown
  misc_feature (293)..(293): n = unknown
ccggtgcaatttgtcatttgccccaacataaaatggtggggcccgggcataaggtattaaaaaaatgggaattgtgcattttatgacggggcaatcaacttctgacgaattctttttacacatatttttagaaagatcatatacataagttaggggggcattcgaaaacctgcctttaccatcttttgagaaaaaagtatcttgtgcaggctttcggatctggctgatatcctacaacccgccatgtaggttctggcgncttacagttttcccaggtttgatgagcacatatnatctacccaaatggagcatcggaattgagtctctgcaatgattggtg

SEQ ID NO: 897 - DNA, 335 bp, Ctenocephalides felis
  misc_feature (41)..(41): n = unknown
  misc_feature (65)..(65): n = unknown
  misc_feature (99)..(99): n = unknown
  misc_feature (106)..(106): n = unknown
  misc_feature (109)..(109): n = unknown
  misc_feature (252)..(252): n = unknown
  misc_feature (317)..(317): n = unknown
gcgctggtcaacgtgaattctttggattgggcaactgcttnaccaaaatcttcaaatctgatggnctccctggattgtccgtgggtttggagtatctgntcaaggnatnatcatctaccgtgcagcatactttggattctatgacaccgctcgtggaatggtgccagacccaagaacaccccattagttataactgggccattgcacaacccgcacaactgtgctggattgtgtatattcattcacacttgnccgtagcgtatgatgatcaatctggacctgccaaagatgaaatgttgaccttggccgggaacacnctaagccaattttgagaa

SEQ ID NO: 898 - DNA, 268 bp, Ctenocephalides felis
  misc_feature (89)..(89): n = unknown
  misc_feature (170)..(170): n = unknown
  misc_feature (240)..(240): n = unknown
  misc_feature (242)..(242): n = unknown
  misc_feature (257)..(257): n = unknown
ccaaatggcttgcactttgataaaacggagttgcgatgcatacccacgcccccggcgaagaatgcaaaagtgagattgctaagtaaggnttaaaccaggaaaacaatcttgaatagactaattaggattcaaattatcataaagtagtcaattaatataataaatacacnaatgatctgtgcaattaaatataaaaaatatgtataaaaattaaaatgtataaattgtattttatgtaangngcaccaaccaaatgncattactatag

SEQ ID NO: 899 - DNA, 299 bp, Ctenocephalides felis
  misc_feature (29)..(29): n = unknown
  misc_feature (35)..(35): n = unknown
  misc_feature (213)..(213): n = unknown
ttaaagttaaagaccctcgacaaaatccngggggncgaggtttccaaattaatttaaccagggggtaaaattgtaaggggatgaatttgaagatgcttaaggattggttttcacccgtgcaggaaaaatttgataacgccaattgctaggcttcccaatattattcataagtgggacgccattggaaaattcccatgtgcttttacatttttnggcaagcccgggacatatgtcttgatcatcatatcgccgtaggcgggaaaattaggggcttctaaattttatgaccagtatttcgt

SEQ ID NO: 900 - DNA, 114 bp, Ctenocephalides felis
atttttcttctggtcattatgctgaattgcaagaaccttgttaatgctgcgtgcaccaacaacgcgcctccaatgaagatattccgtagccgaagagttcttctcagtgatggt

SEQ ID NO: 901 - DNA, 287 bp, Ctenocephalides felis
gcatgtgtggaagttgaagctttgaaggatggtattgatttctgcaccaaaattacaagagcaagatttgaagaattatgctctgatttattccgctctactttacgcccagttgaacaagcgttaagagatgcaaagttagacaaaggagccatacatgatgttgtattggtgggaggttccacaagaatacctaaaattcgatctctgctacaagaattctttgcaggaaagaccttaaattcttccataaatccagatgaagctgtggcttatggtgctgcagt

SEQ ID NO: 902 - DNA, 370 bp, Ctenocephalides felis
  misc_feature (340)..(340): n = unknown
  misc_feature (359)..(359): n = unknown
  misc_feature (361)..(361): n = unknown
aagtccaatccaagagtggaaactttttcaggaaagctactagagaagtgtcatttccccagtgggatcgagaaataatcgcacaattagctgtgttcgtgccctggccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggntatatacagcattcatttnanaaaaaaaaa

SEQ ID NO: 903 - DNA, 280 bp, Ctenocephalides felis
  misc_feature (41)..(41): n = unknown
  misc_feature (60)..(60): n = unknown
  misc_feature (222)..(222): n = unknown
  misc_feature (242)..(242): n = unknown
  misc_feature (247)..(247): n = unknown
cagggggtatatttataaatatggtcaaaatccgcactggngggccaaatttattttggncaaagggttatggtaagaatccagggtttcttgatcatgtaaaaatggtgggccattatcttaaattaaaaaaaatattatattcagaatggatatataatccattcaactttctaaaacgaacaaagaaatctgcgccacgtctgatatctgggaatatgnattggatttaatatatatgntaagnggttaaaaaaatatttctatttcatatacctgg

SEQ ID NO: 904 - DNA, 407 bp, Ctenocephalides felis
  misc_feature (222)..(222): n = unknown
  misc_feature (289)..(289): n = unknown
attagcattgggaaatcttgcccccaattttttaaccatttatttaatcttatggtctagaaatcaaagtggtaaggtcaagggtttggtttagcttaataaaggtaaacattttaaaatggtaatggaatttatctgcaaatagtcaaaatcaaaattactatataatggattattgaaataatgcttttatagattgcatttcaatctgtattaaattgnatgtaaatcacagcacaagatctaacacacaattcatctaacagaaagaactaaataattttaatgntattaaaaattcatataaaataacttttacaataaagtaaccttacatgagatgtgttgatttcagatcttttcatacaacagtgctttctgtataaacaatataatataaataacgg

SEQ ID NO: 905 - DNA, 421 bp, Ctenocephalides felis
  misc_feature (6)..(6): n = unknown
  misc_feature (16)..(16): n = unknown
  misc_feature (18)..(18): n = unknown
  misc_feature (58)..(58): n = unknown
  misc_feature (408)..(408): n = unknown
tttttntttttttttnancatttttaatttatttcatcaactgccttgaaattaaacnagtaaagaactattattcttaaattaaagggaaattttacatcatacattcaacatgaatcaattctaaaattatgtgaataaccaaaattttaaaccattaacacaaatattttttattcccacttaacttattacttattaaaatattacttggcaaggatttttatatttttggatttttttagggatattataaagacgcctttagttgttgccttatgaataaaatcatatttataatacattcacatattatatactaaactattgagaagacttagacgatttaatggaattaatatgaaggaatttattaatttaaattttataaatataaaaaattttagngctttttttaaga

SEQ ID NO: 906 - DNA, 373 bp, Ctenocephalides felis
  misc_feature (8)..(8): n = unknown
  misc_feature (50)..(50): n = unknown
  misc_feature (77)..(77): n = unknown
  misc_feature (178)..(178): n = unknown
caactcanggcaatggcaggatggatatctttaatgatgggtccgattangaagtgttgttggaagcaatgttgtangaataattctagattataattgcgatttaacatttttaatatcaggaacatctctgatagcatgtggagtgattgcattctttataccgaacatttatcanaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgcatgaaaattaataactctttattgttattagattcgatgtaaga

SEQ ID NO: 907 - DNA, 350 bp, Ctenocephalides felis
ttgcgtgaattcgtgcagtcaccccgaaatgcagtattgtccggaaataggagcagatccggttaaggaatcctgtagcccagatcaagtgtgcgctgatcaaagtggatatctacagtgcaccactaaagaaagtacagtctgcaaagtacaagggttcaaatgtccgcaccatcgagattttatccaaatataaatgattgtcaaagctattattattgtgacgaaaatagtataggaacccaatattattgcccgcaaattttgcatatgatccgttacgtcataattgcggacctatggctctgggcacaaaatgctatacagttacatgttctgccaggctaagg

SEQ ID NO: 908 - DNA, 280 bp, Ctenocephalides felis
  misc_feature (19)..(19): n = unknown
  misc_feature (21)..(21): n = unknown
  misc_feature (179)..(179): n = unknown
  misc_feature (196)..(196): n = unknown
  misc_feature (205)..(205): n = unknown
tttttttatttttcaattncnaaaatcagaaaacagttatttccaagaacatggggtcttggtcccttcttttaagcttatttctatcctaaagtgttaactattactacctaaactgcgatgatatttgtgatgaatgatgttgacatgatgtccgaagacgttggctaagatgcggnaaaattctgttcctggncatcatcgntcccctttcctggtaatctttacttgttcccaatcttcagaacgaccgtctaacgtggagcagctttcgagccag

SEQ ID NO: 909 - DNA, 398 bp, Ctenocephalides felis
  misc_feature (208)..(208): n = unknown
ctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttncaacattaaagaatgcataaatgcctgttcttcattgtgtctttacactcggtcgtactattcgtagtatcaatgaagtcgtccgcctaagcattgatgaattttggacaacgtagcatattgtacttggtactcctggatgagcgttttgaaattctgcattttacttatgatatcgggaaaccacatg

SEQ ID NO: 910 - DNA, 454 bp, Ctenocephalides felis
  misc_feature (29)..(29): n = unknown
  misc_feature (57)..(57): n = unknown
  misc_feature (103)..(103): n = unknown
  misc_feature (144)..(144): n = unknown
  misc_feature (403)..(403): n = unknown
gaggcggccgcccggccgtgccaggaccntttaccaccatttccaaaggttccaatnccattttattcctatcttaaaatattcaaatttatatcaaaatggntcggaaatctattaaatggttggcaaacaattcgggaaacnagatttttcaacgagaaattatgctagtgcgtctgaatatttaattaatgactcaaaatattcgttttttgagacaactgggcttggacaaaagcaatcaaggtgtttatgatggtcaatggttcggatctggccctacagtaaaatcagcgtgccccagcaatggtaaagtgattgcagaaacaatatcaggcacaatcgctgattacgagagatgtgtgaaagcagcagaaaagcttggccagaatgggccagcttnctgctccaagacgaggagaaatcgtaaggcaaattggagatgctctccgag

SEQ ID NO: 911 - DNA, 500 bp, Ctenocephalides felis
  misc_feature (48)..(48): n = unknown
  misc_feature (272)..(272): n = unknown
  misc_feature (352)..(352): n = unknown
agtgagggaggggacaagaagcctgaggcatcttcaacttcaaatggnagttcgtccacccctcaagagggtgggcaacccgttcagaacaccgttacagaaagcactgcttgagcagtggaacatgtctcgggaatctcaaagatacctttagcgaatacaatatctataactgtttgctaaaataacatttttatagacatcccctttaaaatgataaggaaaataggttgcacacatattttctaatgcataaaaactgcaggattggntttcttttttatttaatttatttatgtgtgaagtatgaaacaatgcttattgctgtgcaacctctttggttatgtattgntaaatcataaaacgtaaagatctgatttttagtttggttacattttgacaaacctgcattagaattgatttgcagtgagtaatttagaggttgactttaatttcattttaaaataataaagaaaaatgctttacgatgcatatcccat

SEQ ID NO: 912 - DNA, 500 bp, Ctenocephalides felis
  misc_feature (487)..(487): n = unknown
ctaaatattgtgaaataaatcattttcaaaatgggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaagggatgccttaaaggccaacaccaaaaagctctaggttttgcacaagaagctcgtgctaaggtcaaggcttgcagggatgataaacgtgaggaattcaaccaagttcgccaaaatggcttggccgcctggagagaagccagggagaacgccgaaccctcagagcacaagccaaggagtgcntgtaccgcaccgt

SEQ ID NO: 913 - DNA, 406 bp, Ctenocephalides felis
  misc_feature (5)..(5): n = unknown
  misc_feature (151)..(151): n = unknown
  misc_feature (347)..(347): n = unknown
  misc_feature (350)..(350): n = unknown
taaantcataaagcttctatatttatatattttaaataatcagaaattctatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgtttatcaaagtgcaagccatttggacaatcataatggtttatttgccatttgntgntaaccaagaaacattgataatattttttacaatctcttcgatcggaaaaaacggtt

SEQ ID NO: 914 - DNA, 413 bp, Ctenocephalides felis
cattaattggaaggtggtcattaaatattaccatgcattatacaattatatttataattatagcggtaacaaaataaaataattttgtgctaaagcctctgcaataaaaagaactgactcatatgtataaagatttaattgtataaatgcaatacaaattaattcagttaaaatttaagaacatattgcatgacagtttggtataaagcataaatgactgcttagttttttttttttaatgaaagtttaagacatctattataggaagatatatggcggaaacagaatcattacatatacatcaacatcaatgtgcattacttttttttttaatttctcttcagatagaatacgatgaatataaacataagtatgaattataaaattgtattgtatactgtataaaataaatg

SEQ ID NO: 915 - DNA, 420 bp, Ctenocephalides felis
cggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttggtgcagctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 916 - DNA, 266 bp, Ctenocephalides felis
tctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagctttcaacattaaagaatgcataaatgcctgttcttccattgtgtctttacactcggtcgt

SEQ ID NO: 917 - DNA, 124 bp, Ctenocephalides felis
cccatccataccatccttaccatccttaccatctttcccaaccttgccaacatcttccccaacagcaggatttccttttggccgaaaatctcttgatatgcaaacaaaaactggaactaaatgt

SEQ ID NO: 918 - DNA, 175 bp, Ctenocephalides felis
  misc_feature (3)..(3): n = unknown
  misc_feature (62)..(62): n = unknown
  misc_feature (168)..(168): n = unknown
gtnccgaaagactgtgccgactgcttaaaacttactgataactaaattagtttaagaattgnataacaaactgtaaacttcctaaaaatgtctagtgatatattatttgtggtctaatggttctagcttatgtagctttttgacaaataaaaattgtttataaaaaanaaaaaaa

SEQ ID NO: 919 - DNA, 383 bp, Ctenocephalides felis
tatcttacatcgaatctaataacaataaagagttattaattttcatgtcgatgttttagaaaatgattcagtagcaacttctgaattttctttgtaatcgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 920 - DNA, 448 bp, Ctenocephalides felis
  misc_feature (44)..(44): n = unknown
  misc_feature (170)..(170): n = unknown
  misc_feature (216)..(216): n = unknown
ccatcccttcccatcccttacccatcttttcccaacccttgccnaacatctttccccaacagcagggatttcctttttggacccgaaaatctcttgatatgcaaacaaaaactgggaactaaatgtacaaaagggagaagtttctaaagacgatttaaattctacatgtncctagtgagtgtgttatatgaaattgctattgcatattacatacangcttaataaagggtatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttggtatagacaatttacttaataattatgagttgcatcattatgcaatg

SEQ ID NO: 921 - DNA, 500 bp, Ctenocephalides felis
atccagtcagactgtttaggtgcaagtgtcacttcttccccatccataccatccttaccatccttaccatctttcccaaccttgccaacatcttccccaacagcaggatttccttttgaccgaaaatctcttgatatgcaaacaaaaactggaactaaatgtacaaaaggagaagtttctaaagacgatttaaattctacatgtacctagtgagtgtgttatatgaaattgctattgcatattacatacaagcttaataaaggttatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttggtatagacaatttacttaataattatgagtggcatcattatgcaatgatttatcactattattt

SEQ ID NO: 922 - DNA, 500 bp, Ctenocephalides felis
  misc_feature (3)..(3): n = unknown
  misc_feature (8)..(8): n = unknown
  misc_feature (12)..(12): n = unknown
  misc_feature (23)..(23): n = unknown
  misc_feature (79)..(79): n = unknown
  misc_feature (279)..(279): n = unknown
  misc_feature (341)..(431): n = unknown
aantttgnaggntccctacaccnaacaaaaattggctggcccatttcaaatcgctttggttcaaaaaggtcatcaaganaattccccataggataaaattaaacttctttttgggttctaaaatttaaattccttgcataattgctcacgacattgttttaaagtgagaaaatctgggttgggtcctaaacttgtatcatagccatattttccaatagtcattaaaccatcaacaagtaggtttgggcaattttctttcacatatttgtatagagttgntgcttcatttgggtgaacaccatgtttttctatttcaccacttgtatttatttgaatcataactcttaatttatcaccatgaattttattagctgaatctaattttgaccaagcattctgccactgtcggctaatttaaatgagtggattgnttcgaccatatatatcccaggtatgttaaccccttattaatttatttctttgaagatgacctataaaat

SEQ ID NO: 923 - DNA, 491 bp, Ctenocephalides felis
  misc_feature (72)..(72): n = unknown
  misc_feature (113)..(113): n = unknown
  misc_feature (162)..(162): n = unknown
  misc_feature (164)..(164): n = unknown
  misc_feature (201)..(201): n = unknown
  misc_feature (232)..(232): n = unknown
  misc_feature (364)..(364): n = unknown
  misc_feature (476)..(476): n = unknown
  misc_feature (478)..(478): n = unknown
  misc_feature (488)..(488): n = unknown
ttttttttttttttttttcataaagcttctatatttatatattttaaataatcagaaattactatagttaangacattttgtttgtgctccttacataaaatacaattttatncattttaatttttatacatattttttatatttaattgcacagatcattngngtatttattatattaattgactactttatgataattngaatcctaattagtctattcaagattgtttncctggtttaagccttacttagcaatctcacttttgcattcttcgccgggtggcgtgggtatgcatcgcaactccgttttatcaaagtgcaagccatttggacaatcataatgttttatttgccatttgttgntaaccaagaaacattgataatattttttacaatctcttcgatcggaaaaaacgttttcacttttgcatgcagtctgcccgagaaaaatttgggcaaaccattcgttgacgtngnttcacatttnagt

SEQ ID NO: 924 - DNA, 398 bp, Ctenocephalides felis
  misc_feature (30)..(30): n = unknown
  misc_feature (52)..(52): n = unknown
  misc_feature (102)..(102): n = unknown
  misc_feature (123)..(123): n = unknown
  misc_feature (137)..(137): n = unknown
  misc_feature (139)..(140): n = unknown
  misc_feature (152)..(152): n = unknown
  misc_feature (163)..(163): n = unknown
  misc_feature (167)..(167): n = unknown
  misc_feature (234)..(234): n = unknown
  misc_feature (240)..(240): n = unknown
  misc_feature (384)..(384): n = unknown
ggggagttcaaagctcatatagtgtcattntcaagatcacaccctaatggtngacaaagtcataatacatgggtcacatgcctagcaatttaagtaacagtntttttatcgggaaaatttgtnaataataaattatngnngatgtatatatncactacactgngagncattaatattctatatttaaatttaaataatacataaaatcatattttttctactaaacaatgcaanggatgncttatatgaatttggatactcttcatatttaaaacagttttgtcataatttaagaagtttccaaaaaaataagttttatataaggggtttacataattcatcgagattaacacacactcaaccatccaatatattaatttatgngatttaatatatga

SEQ ID NO: 925 - DNA, 393 bp, Ctenocephalides felis
  misc_feature (50)..(50): n = unknown
caagtccaatccaagagtggaaactttttcaggaaagctactagagaggngtcatttccgccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaattaaatatacaatagtattttaaatttggcacacatctatctatgcatccataaataaaggttatatacagcattcattaaaaaaaaaattaaaaaaaaaaaaaaaaaaaaaa

SEQ ID NO: 926 - DNA, 185 bp, Ctenocephalides felis
  misc_feature (18)..(18): n = unknown
  misc_feature (54)..(54): n = unknown
  misc_feature (134)..(135): n = unknown
  misc_feature (153)..(153): n = unknown
  misc_feature (158)..(158): n = unknown
  misc_feature (173)..(173): n = unknown
  misc_feature (176)..(176): n = unknown
aggatgagaaactactgnacagaatacaccggcaatgtaaccagcagcaaaggngacaaccaattgttcacctttagtgcattctgctctgggtttgggaaccacatgagtgtataacaattcaactgtctttnnaaacaagcaaacttcatnatggnatatgggatttgctnatncacaatggt

SEQ ID NO: 927 - DNA, 423 bp, Ctenocephalides felis
tctgaactaaacattgttaattcaaatctcaattctaaattaaatctttcatggaatcttgcttgaaaattgaaaattactctccattattttacatgcgataatttattttgttgtagatcaaagatataagaattagtgataaatttaaagaaataagagaacaataaacatattgttaaatcatcattttagatttgtttattgacatcccgtaagtgattagtaatttgataatgaaacattttaatataaaatattatcataaagtatatggcattatttagaccaagaaatgttttacttgtatatatgtatttaaaatatttatgtttgtgattttatttaatgaaataagagttgcgtcttcgatgcacgtaacatcgtttttatagtaaatgatagatttatgacaaccgtctg

SEQ ID NO: 928 - DNA, 433 bp, Ctenocephalides felis
  misc_feature (11)..(11): n = unknown
  misc_feature (18)..(18): n = unknown
  misc_feature (22)..(22): n = unknown
  misc_feature (82)..(82): n = unknown
  misc_feature (97)..(97): n = unknown
  misc_feature (125)..(125): n = unknown
  misc_feature (184)..(184): n = unknown
  misc_feature (194)..(194): n = unknown
  misc_feature (231)..(231): n = unknown
aaaaaaatccnattaatngatnggtttaacccctatcaacttaaaattatgtgatacaagcttaaactttgcgtattatgtnaaattaaaatatacnaaaaatatactttgagtaaatatgttgncaatgatatatcattgatatagaaggctttttatcagctttttataaatttcgataacncagatattgnttaataaaattacatgtgacccggcaatgcttgaggnccctgcataaatatatttgaccccattcgctgctgatattgcacactttgttgggattcatcgttaggattagaatggcttgatgcaggtatggttcccatgccatttgtaatatgcaatccatttaaatgttgagacatttgatgtattaacataagattagggcctgttgtggttgcctattggttgaggattattcgct

SEQ ID NO: 929 - DNA, 310 bp, Ctenocephalides felis
tcttggctataagttcgttgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 930 - DNA, 171 bp, Ctenocephalides felis
  misc_feature (5)..(5): n = unknown
  misc_feature (20)..(20): n = unknown
  misc_feature (23)..(23): n = unknown
  misc_feature (65)..(65): n = unknown
tttanaaaaaatttattcanttnattaaatggataaaaattaaaaaaaatgcgaatacctttttntccagcatttggaaggtcattggtggtttggttagataagcaattcattaattagcttagataatttttttatataaacttttattatatataaaaatttatatgt

SEQ ID NO: 931 - DNA, 371 bp, Ctenocephalides felis
agtgttatttatagattattataaatttaatataattgtgtatagtgcctgatgttaaaataccaacataatttatgcagataatatatctttaatgctcacaagacaatatctaatttttcttaaaaatacatataataaatatattaaatgttattgtatttttacacaaatgagctaatatttttacaaatatggataaatttactattatataaatattatattagtcactatttttacaaggattgtgtatcataatagttaatatttgacataatcatttaaacacgttgttataattaatgttaaactttatgaatgaaaagaaatagaaaataactatttgtctataccaaaaaaaaaaaaaa

SEQ ID NO: 932 - DNA, 470 bp, Ctenocephalides felis
  misc_feature (13)..(13): n = unknown
  misc_feature (20)..(20): n = unknown
  misc_feature (79)..(79): n = unknown
  misc_feature (116)..(116): n = unknown
  misc_feature (139)..(139): n = unknown
  misc_feature (165)..(165): n = unknown
  misc_feature (169)..(169): n = unknown
  misc_feature (180)..(180): n = unknown
  misc_feature (201)..(201): n = unknown
  misc_feature (257)..(257): n = unknown
  misc_feature (343)..(343): n = unknown
ttttttttttttnctttttnttagagatttcaaagctcatatatttcattatcaagatcacacctaatgttgacaaagncataatacatgatcacatgcctagcaatttagtaacngtatttttatcgggaaaatttgnaaataataaattatagtagatgtatntatncactacactgngagtcattaatattctatatntaaatttaaataatacataaaatcatattttttctactaaacaatgcaatggatgncttatatgaatttggatactcttcatatttaaaacagttttgtcataatttaagaagtttccaaaaaaataagttttatataaggnatttacataattcatcgagattaacacacactcaaccatccaatatattaatttatgtaatttaatatatgatattaaataataaaatacattgaggacagaatactcagatgtaagcagatattag

SEQ ID NO: 933 - DNA, 412 bp, Ctenocephalides felis
  misc_feature (68)..(68): n = unknown
  misc_feature (148)..(148): n = unknown
  misc_feature (199)..(199): n = unknown
aatttggcattggcccaagcataaattggtggggccggggcataagttataaaaaaaatgggatttgngcatttcatgacgggtgcaatcagcttctgacgatttctttttacacatatttttagaatgatcatatacatagttaggngggcattcgaaaacctgacctttaccatctttgcagaataaagtatcttgngcagctttcggatctggctgatatcctacaaccgcgcatgtagtttctgccgcttacagttttccccaggttttgatgagcacatatcatctacacaaaatggagcatcggaatttgagtctctgcaattgattgttgtaattggggtttcttgtcagcgcacaacttcaaagtagaacaatcgtgacaaaatgttcccaactgcttattagt

SEQ ID NO: 934 - DNA, 363 bp, Ctenocephalides felis
tataaaaaaaatgggatttgggcatttcatgacgggtgcaatcgcttctgacgatttctttttacacatatttttagaatgatcatatacatagttaggtgggcattcgaaaacctgacctttaccatctttgcagaataaagtatcttgtgcagtctttcggatctggctgatatcctacaaccgcgcatgtagtttctgccgcttacagttttcccaggttttgatgagcacatatcatctacacaaaatggagcatcggaatttgagtctctgcaattgattgttgtaattggggtttcttgtcagcgcacaacttcaaagtagaacaatcgtgacaaaatgttcccaactgttattagt

SEQ ID NO: 935 - DNA, 419 bp, Ctenocephalides felis
  misc_feature (46)..(46): n = unknown
  misc_feature (90)..(90): n = unknown
cggttgcaatttgtcattgcaccaagcataaattgatgggtccggngcataggttataaaagaattgggatttgtgcatttcatgacggngcaatcagcttctgacgatttctttttacacatatttttagaatgatcatatacatagttaggtgggcattcgaaaacctgacctttaccatctttgcagaataagtatcttgtgcagctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 936 - DNA, 500 bp, Ctenocephalides felis
  misc_feature (44)..(44): n = unknown
  misc_feature (486)..(486): n = unknown
aaactaggaattatagtgtctataacacctataaaatacttatncttaattacataaaataactttcgacttaattttaaataaaatatcaatataaaggaattgaatcctttaatttttgcaaatgtaaattttgtatttatttagccaaaatttggagatctgtgtgttttaggaataaccagaacaattttctattttgtatagtaaatatcatttgctacatataaaaatactctatattatacatactctgttcatttatttaattttggtgacaatagtccgattttccaaaaaataacaatatgcttaaaattacataaaatatactaattttgtgacaatatctacaacataatcttacttgcaaaagaaacataatttaattgacgaacaaacataaatgtggacttaacaaaatatttaaacaaaatcttcgaatgctttttttcaagcatacatttgagggataaatattattgnttttatttctgcta

SEQ ID NO: 937 - DNA, 247 bp, Ctenocephalides felis
aatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagt

SEQ ID NO: 938 - DNA, 484 bp, Ctenocephalides felis
  misc_feature (28)..(28): n = unknown
  misc_feature (83)..(83): n = unknown
  misc_feature (92)..(92): n = unknown
  misc_feature (96)..(96): n = unknown
  misc_feature (105)..(105): n = unknown
  misc_feature (160)..(160): n = unknown
  misc_feature (171)..(171): n = unknown
  misc_feature (211)..(211): n = unknown
  misc_feature (221)..(221): n = unknown
  misc_feature (408)..(408): n = unknown
ttttaatatttttttctggatttttccnttaaaatttttttctggttttatattttattttggtttatttaaagagatttagntttttaagngagntgggtttgntattctgcattcctgtcaaacgacttatattatattacataataacacgaccacntaaaaatttgntctgaataaataaacttcattaaacataaaactaagatgnattcccaagnatcttatattaatttactacttgcttaacgtaagataataatgataaatatttttatatatactattctatcaaaatttctatttctttgcaattcattacttcattcttatttttatctttaacaatttaaattccatgtcagcgccgggactcgcccgacgatcgagctaagaaaatctaggcgnaaattatttttataaaattatgctcaataaattggttaattttttaaaaaatcaaaagtgctcggcatgtcgtccg

SEQ ID NO: 939 - DNA, 418 bp, Ctenocephalides felis
cggttgcaatttgtcattgcccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataaagtatcttgtgcagctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattag

SEQ ID NO: 940 - DNA, 500 bp, Ctenocephalides felis
gtgagtgtgttatatgaaattgctattgcatattacatacaagcttaataaaggttatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgttttaagtataaatcttattagggcacaatatgaaaataaaaataagaactttatacaaaagctttttttatacaatatgcttcttgcgctattaagttaagaaattttatttatgcttgtaaaaaacaataaatgctttatttaaaaaaaaaaa

SEQ ID NO: 941 - DNA, 464 bp, Ctenocephalides felis
cttggttttgcccttcgcttaacgtgggcgcgggccggggacatatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttcaacaacacttcctaatcgacccatcattaaagatatacatactgccattgcctgagttgtgtagggtcgaaaggccattaatttataataattattttaatttgg

SEQ ID NO: 942 - DNA, 496 bp, Ctenocephalides felis
  misc_feature (90)..(90): n = unknown
  misc_feature (170)..(170): n = unknown
ttttttttttttttttttatttcataaagcttctatatttatatattttaaataatcagaaattactatagttaatgacattttgtttgngctccttacataaaatacaattttatacattttaatttttatacatattttttatatttaattgcacagatcatttgtgnatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgtgacgcgcttcacatttcagt

SEQ ID NO: 943 - DNA, 340 bp, Ctenocephalides felis
  misc_feature (9)..(9): n = unknown
  misc_feature (12)..(12): n = unknown
  misc_feature (26)..(26): n = unknown
ctttaaaantgnaacatctatatatntgaaatcatgatcggctccctggtttatttctatcgattactacagtattatatttataatatgttcaatatcgcactgtggtccaattttattttgaccaaaggtttatgtaagaatccaggttttcttgatcatgtaaaatgttggtccattatcttaaattaaaaaaattattatattcagaatgatatataatccattcaactttctaaaacgaacaagaaatctgcgccacgtctgatatctgtgaatatgtattgtatttaatatatatgttaagtgtttaaaaatatatttctatttcatatacttg

SEQ ID NO: 944 - DNA, 324 bp, Ctenocephalides felis
  misc_feature (18)..(18): n = unknown
gttttactttatgtgttntataaaaaaatattatggttgaacacaggctcgcaaatatgataaggcatttaagaattttacaatttagatctttttaaatccatgaatatatttgttctaatcaaaattattcattttacgcttaattttattggttgaactaatagatagatagataaagatatagagttaatataaaaatgaagaaaataaaattaaaagtaagaaataatacggacttctaaatgtagggggaagtcccctagtggcggacacctaaagttatttataaataaatcaaaaaaaaaaaaaaaaaaaaaaaaa

SEQ ID NO: 945 - DNA, 213 bp, Ctenocephalides felis
ttcatgcaaagaacttcataataaagcaatatttaaatgattgattttgttgtgtaattaagtaatgttgaatatacaagtgtttagttaaatgttttgtttcaattcagaagacgtctgatttgcaaacagctttgagtaattgcactataaaatgtataaacgtcagcttaaaattatgtcaatgtttatcatgcacttgtaaattaaggt

SEQ ID NO: 946 - DNA, 500 bp, Ctenocephalides felis
gtgaagacgacgtcaacgaatggtttggcccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccaccccccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattcatgtatctttttaataaaaataaatcg

SEQ ID NO: 947 - DNA, 500 bp, Ctenocephalides felis
  misc_feature (32)..(32): n = unknown
  misc_feature (40)..(40): n = unknown
  misc_feature (43)..(43): n = unknown
  misc_feature (83)..(83): n = unknown
  misc_feature (91)..(91): n = unknown
  misc_feature (125)..(125): n = unknown
  misc_feature (159)..(159): n = unknown
  misc_feature (185)..(185): n = unknown
  misc_feature (369)..(369): n = unknown
  misc_feature (390)..(390): n = unknown
  misc_feature (406)..(406): n = unknown
  misc_feature (430)..(430): n = unknown
  misc_feature (442)..(442): n = unknown
  misc_feature (482)..(482): n = unknown
gaaatcaagaaattgttgtaaattaagcaatnaacaaccntancaaacaaagagaaaaatctaaaaacaatttaaattagcanaaccaagngtatttgaatttcatttttgcacaagttaccttnttgtattaaaatatatgtatatttatgaatatgnatttcttgtattttaggttaaattcnctatagaataatttggaaatacatattcataatgctaaagtattaaattggcttttttccattaaaatcctatttaacattatacatatattttattgtcaaatgtgaggcggtatggaatcacgggtggctgctttctgagtagtcgaaccttttaggcaaaaattgtgtagatcaaactcanttctacaatcttgagctcatnccattctcagaacatncatgtatttaagttaacttattgnatttaacagctnttgaggaaatactgtgaatatgtttaagataaatacaagngaaattggcggcatctaa

SEQ ID NO: 948 - DNA, 328 bp, Ctenocephalides felis
  misc_feature (36)..(36): n = unknown
cctgcaagaatgagtttcagggaacgaaaagaatcngccaaatgcatgcaaaagggtgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaactaaaaaa

SEQ ID NO: 949 - DNA, 500 bp, Ctenocephalides felis
aaaaaaatcacaataaatagatagttttaacacctatcaacttaaaattatgtgatacaagcttaaactttgcgtattatgtaaaattaaaatatacaaaaaatatactttgagtaaatatgttgtcaatgatatatcattgatatagaaggctttttatcagctttttataaatttcgataacacagatattgataaataaattacatgtgacccggcaatgcttgaggccctgcataaatatatttgaccccattcgctgctgatattgcacactttgttgggattcatcgttaggattagaatggcttgatgcaggtatggttcccatgccatttgtaatatgcaatccatttaaatgttgagacatttgatgtattaacataggattagggcctgttgtggttgcctattggttgaggattattcgctagggacatttgagaactgttctgaatcaattgcatttgtggctgactttgatttactattgctgatag

SEQ ID NO: 950 - DNA, 500 bp, Ctenocephalides felis
  misc_feature (30)..(30): n = unknown
  misc_feature (453)..(453): n = unknown
  misc_feature (471)..(471): n = unknown
cacacaattagcaataggaaaatctagccncaaatatttttaacaatttatttaatacttatgttctagaaatcaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgttaaacaatataatataaataacggtcctgccggcgggcgctcgaaagccgattttacaaaattcanggcgcaagggctgctaangaagcgggacacgtagaaagccagtccgc

SEQ ID NO: 951 - DNA, 449 bp, Ctenocephalides felis
  misc_feature (15)..(15): n = unknown
  misc_feature (53)..(53): n = unknown
  misc_feature (61)..(61): n = unknown
  misc_feature (147)..(147): n = unknown
  misc_feature (162)..(162): n = unknown
  misc_feature (166)..(166): n = unknown
  misc_feature (181)..(181): n = unknown
  misc_feature (183)..(183): n = unknown
  misc_feature (325)..(325): n = unknown
  misc_feature (418)..(418): n = unknown
ttagaggatttcaanagctcatatatttcattatcaagatcacacctaatgtngacaaagncataatacatgatcacatgcctagcaatttagtaacagtatttttatcgggaaaatttgtaaataataaattatagtagatgtatntatacactacactgngagncattaatattctatntntaaatttaaataatacataaaatcatattttttctactaaacaatgcaatggatgtcttatatgaatttggatactcttcatatttaaaacagttttgcataatttaagaagtttccaaaaaaataagttttatataagggntttacataattcatcgagattaacacacactcaaccatccaatatattaatttatgtaatttaatatatgatattaaataataaaatcattgnggacagaatctcagatgtaagcagatattag

SEQ ID NO: 952 - DNA, 487 bp, Ctenocephalides felis
  misc_feature (20)..(20): n = unknown
gcagcctgcatgttcgttgnttacaataaacgtcacaatttaatcgtgtctgcagtcttcagctctgttatatcttgtggaaatgcagcgttggactgtcttatcaccgaggtgtttccaacaaatttgagggctactggtgtggcaatatctatggtagctgctcgacttggaggcataattggcaatgtggtaattgcaactttattagacatgtattgccagccccaacatttattgtagcactactattggctggaggtggctgatgtgtctatttttgcctaacacgaccagggaaccactttcataagaaaagctcatcatataacagtcaggcgatataataaatatatttattcttctgctccatcccaaaaacttgattttgaaattcaaatcttataaaataatgagttttcttagaaaaatgttataaataattatcctaaagcattcataaatttcattaatgatgacttcgtat

SEQ ID NO: 953 - DNA, 500 bp, Ctenocephalides felis
ttaaggatttcaatttacctcaactgcaagtgttggatttaagcgagtgccagttttctcttatagatgctgatatgttcagaggaattggatctcttagcagtttgaatctcagtagtaatggaatagtagaaatctatccaagagctttcgataatttgattgacttgagatttattgacttgacacataatctacttactttcttacctgcaacgtcttccaaaataatgatcatttggatgttattaaaatttctaacaacccgaatctcatgaatttgcctagatttcattcaaatttgtcatcgtttaccacttatatgtttgaagcagtaaattgcggattacttagcttagacaaacatacatttgctgaaatgccttccatggcgcaactgaatttagctcagaactcgatcaaagatttaaaatataatattttctggcatatgcgcaatttaatcagcttagatttgagtaataataaaatcaacaaac

SEQ ID NO: 954 - DNA, 437 bp, Ctenocephalides felis
  misc_feature (14)..(14): n = unknown
  misc_feature (47)..(47): n = unknown
  misc_feature (73)..(73): n = unknown
  misc_feature (177)..(177): n = unknown
  misc_feature (180)..(180): n = unknown
  misc_feature (199)..(199): n = unknown
  misc_feature (260)..(260): n = unknown
  misc_feature (295)..(295): n = unknown
  misc_feature (394)..(394): n = unknown
tttttttttagacntgatagaagaatttattattaatacatattatntatattgaatatagaaagcaaatctnttataaaaatattaatgcacttatgtcaatagtttcatatagtattgccaggaaaagctaagtattaagtataatatatttagttattcttaaacatatgttgntgntggtttgataaaagctggncttaaaatgactttatatacagcaattatcttcaataatcctttccacaattttgctcggngtgttttagtttgctcaaatctatgggtgtattgntttccacatatgtcttaatttctttcatcaattccgatgatgggttttgctcacgtgtgagaatccaagctaattcatttttcctcgtggatgaattgngcagctccacacaatagcaaatttatcaaaatcgctttttagt

SEQ ID NO: 955 - DNA, 419 bp, Ctenocephalides felis
gtgatttccctgaattgagtgttgaaatcgacggcgtaactgaatctattatgaagcgtactgctcttgtcgcaaacacatctaacatgcctgtcgccgctcgtgaagcttccatttacaccggtatcactctcagtgaatacttccgtgatatgggttacaacgtatctatgatggctgattccacttctcgttgggctgaagctttgagagaaatttcaggtcgtttggctgaaatgcctgccgattccggttatccagcgtacttgggagctaggttggcctctttctacgaacgtgctggccgtgtaaaatgtttgggtaatcctgaacgtgaaggctcagtatcaattgtaggagctgtatcaccgccggtggtgacttctcagatccgtcacttcagctacattgggtattgt

SEQ ID NO: 956 - DNA, 429 bp, Ctenocephalides felis
  misc_feature (56)..(56): n = unknown
  misc_feature (198)..(198): n = unknown
  misc_feature (227)..(227): n = unknown
  misc_feature (293)..(293): n = unknown
aaggaaaagtctcgtgacgtgcacaatacgaacgctttgacaatactgcgaattgnttgataaatgatgtcggatcaaagattccgatcttgctttcataactttctttaagctgcaagagagaggctccgtttcgccaaattctattcgaattgcatcattcaagagcgggatttttgccacgagcgattgatctgnatgtttggtattatcacatttcatagtgntgattcctacttcggcgtgatttctactccatttagtttctgtaaactctaccagaggatcgaggntttcgcctcgttctaaacttgctacttctaacgcaaaatcggtctattataaaattgtggacattgatggccgaatcgtccattgtttcaaccatgtcaccaagtggcctaggtatataattcggccgcactaagt

SEQ ID NO: 957 - DNA, 387 bp, Ctenocephalides felis
gataaaatgctgttggcccacaagttagaaggtgggctccagagcaaaaatcagcagaatacgacaccttcgagaaggccaattcaaaaatgcaagttttgaccaaattggacgacgaagatccaaaatatcagatgaagaacatcacataaatcaatcaaagtgatttaatttaaataatccattattgtgcaaagacaattgtaaataaaagataagaactttgtcatcaagagtgaacttgtcatggtgtttgcttaaagatttgtgagtgattttatttttgacatacacgtggaagtgaatttgttagtttaagatttaattctaatttaatttagtgtaattgttgtaattaattatttttaagatgcttaaataggtttg

SEQ ID NO: 958 - DNA, 347 bp, Ctenocephalides felis
  misc_feature (28)..(28): n = unknown
  misc_feature (81)..(81): n = unknown
  misc_feature (112)..(112): n = unknown
  misc_feature (122)..(122): n = unknown
  misc_feature (124)..(124): n = unknown
  misc_feature (126)..(126): n = unknown
  misc_feature (163)..(163): n = unknown
  misc_feature (197)..(197): n = unknown
  misc_feature (265)..(265): n = unknown
  misc_feature (286)..(286): n = unknown
  misc_feature (320)..(320): n = unknown
tcagtttacatgcgggtgcctttacagnacatttttttataaataaacgtgatttgcctagccgtcttataaaatacaggntcaacaattccttatacttatcagggctttntaaaataacntncntaatttaaatcaaaattaaattcgagtaacaaaagtngtaaacaaatagaattagttctaatttacttatncctaaactaattcagataagttgagtagatcgcattttcttttaatttaataaaaaaaattatgaggnattaaatatttcacatattgnttttaaatgtttcagatatcttatacaagtttgnacactattattacaaagatttcgcttg

SEQ ID NO: 959 - DNA, 498 bp, Ctenocephalides felis
  misc_feature (19)..(19): n = unknown
  misc_feature (63)..(63): n = unknown
  misc_feature (217)..(217): n = unknown
  misc_feature (340)..(340): n = unknown
cgatcgtcctggaatgtgnagacgacgtccacgaatgggtttgacccaaatctttctcgtgcngaactgcatgccaaaagtgaaaacgttttttccgatcgaagagattgtaaaaaatattatcaatgtttcttggttaacaacaaatggcaaataaaacattatgattgccaaatggcttgcactttgataaaaccggagttgcgatgcatacccncgcccccggcgaagaatgcaaaagtgagattgctaagtaaggcttaaaccaggaaaacaatcttgaatagactaattaggattcaaattatcataaagtagtcaattaatataataaatcacnaatgatctgtgcaattaaatataaaaaatatgtataaaaattaaaatgtataaaattgtatttatgtaggagcacaaccaaatgcattaactatagtaatttctgttatttaaaatatataatatagaagcttatgaattaaaaaaaaaaaaaaaaaa

SEQ ID NO: 960 - DNA, 453 bp, Ctenocephalides felis
  misc_feature (13)..(13): n = unknown
  misc_feature (15)..(15): n = unknown
  misc_feature (30)..(30): n = unknown
  misc_feature (192)..(192): n = unknown
  misc_feature (410)..(410): n = unknown
ttttttttttttntntttttttttagactngatagaagaatttattattaatacatattatatatattgaatatagaaagcaaatctattataaaaatattaatgcacttatgtcaatagtttcatatagtattgccaggaaaagctaagtattaagtataatatatttagttattcttaaacatatgttgntggtgttttgataaagctgtgtcttaaaatgactttatatacagcaattatcttcaataatcctttccacaattttgctcggtgtgttttagtttgctcaaatctatgggtgtattggtttccacatatgtcttaatttctttcatcaattccgatgatgggttttgctcacgtgtgagaatccaagctaattccatttttcctcgtggatgaattgngcagctccacacaatagcaaatttatcaaaatcgctttttagt

SEQ ID NO: 961 - DNA, 492 bp, Ctenocephalides felis
  misc_feature (128)..(128): n = unknown
  misc_feature (203)..(203): n = unknown
  misc_feature (445)..(445): n = unknown
  misc_feature (479)..(479): n = unknown
ccccggttttggccccggttaacggggcgcggccggggacccgatggtttattcataatttgggcccgcaaaagatcatttttcacctcaacctttttctattagtttatatacatgtgaatctttgntatgaaaataaatattttactataactaattttagatagatcgatttatctatgtcgtgcctttttaaatgttgntaaatttaaataaacaaacataatgataatatatattacaaaatataaatctgtgataaaataaagaaaaatgttaacactattttagtcttttcttcttggctttcatctttttctccatcgcttccattttcatgtcttctaaatcttccattattccaatttttttactaatatattcttctctcataacttgagcaaagtttgattccatatttatatcatcatcatcttcgcccggnatcttgtttgcatatccgaatatatctttaatgnattttgaatagca

SEQ ID NO: 962 - DNA, 500 bp, Ctenocephalides felis
  misc_feature (406)..(406): n = unknown
tcatgatcttattcccataataaatgattcatttattaccagcatcagtaggctgtggttcatccaaaatgtaatacttatagtctcctggggcttccaaatatttgagaccgttttcctctttaataggccaagaatttgcttttgctctctcaagagcttcacgagatctgattgtgatgcctctaaagtcattacctttttcatagctttttattccataattgtaagtcaattcgattacaaaatgatcatcttctgatccataaccaatcattgttttgctccagcggtttgcataggggccattgcaagcggcttcacaaccttcactgaattcttcatgacgcaataccttcattgcaagtcatccttatagaatttataggttagtcttctttctggnattttaaaaacaaaatgtaaagctcgccgcttatcatttttaataatcaattcacgcgatttaataaattattaagaaacttcaacttattaac

SEQ ID NO: 963 - DNA, 454 bp, Ctenocephalides felis
  misc_feature (14)..(14): n = unknown
  misc_feature (19)..(19): n = unknown
  misc_feature (26)..(26): n = unknown
  misc_feature (81)..(81): n = unknown
tttaagccttggtntggcnttggcgncgcccggcagtcgatcgggtgcattgtcttgcccaagcataattgatgggtcggngcataggttataaagaattgggatttgtgcatttcatgacggtgcaatcagcttctgacgatttctttttacacatatttttagaatgatcatatacatagttaggtgggcattcgaaaacctgacctttaccatctttgcagaataaagtatcttgtgcagctttcggatctggctgatatcctacaacccgcgcatgtagtttctgccgtcttacagttttccccaggttttgatgagcacatatcatctacacaaaatggagcatcggaatttgagtctctgcaattgattgttgtaattggggtttcttgtcagcgcacaacttcaaagtagaacaatcgtgacaaaatgttcccaactgcttattagt

SEQ ID NO: 964 - DNA, 500 bp, Ctenocephalides felis
  misc_feature (1)..(1): n = unknown
  misc_feature (4)..(4): n = unknown
  misc_feature (14)..(14): n = unknown
  misc_feature (58)..(58): n = unknown
  misc_feature (108)..(108): n = unknown
  misc_feature (240)..(240): n = unknown
  misc_feature (258)..(258): n = unknown
  misc_feature (343)..(343): n = unknown
ntcnagccctggtnccccctcggcgggcgccggcggtcctacacaactcgttacccanaatattatttctatcgattcctgaaaaatttacgttgttttggtgaaagngcatttattcgttacatttctgataacttaaaaactatttgcggaaaactaaaaatatgtttggagaaaatatagaaaattgaatagtctaaaacattttcctaacataggaagaccctacagcaactcggnatactcaaaaaagtttgntgaaaagttgataaatattcacagcgcttcactgttttgttcttgagtttaggaaaagtgcatttatttataacttttgaacggnttatttgattgaaatgaaatattcggcaaatttatagaaaattaaataatctacaaatttttcttttaccgcaacagaaaccacaaaatattcccttcgctaatacgggtaaacatcacaaaatgtatcgaatcaatatttttttaaattgaaattg

SEQ ID NO: 965 - DNA, 448 bp, Ctenocephalides felis
  misc_feature (361)..(361): n = unknown
  misc_feature (373)..(373): n = unknown
  misc_feature (383)..(383): n = unknown
cctaagcacattattacatattttcatcgacccaataacatcaaacgtcgcctgtcaattaaaaatatcaacagcatcacatctaagcttacctagatatactttcattattttgtaattactttttttctgtcgaattattatacaaatgtgaaaatttaatttaatgtatttaatataatattccgaatgttgccaatactcaaaagtttgaatagcactgttactgtgtgaatcgcctggtgaaaaaaactagaatttatttacaaaatggtctagtgcaaaatttagagacacgtaacttacaacagccccaaaagagcgctagagcaaaacaccacgcgatttatacagtaattgntctgtgcattgntatctattgnatgtgtgacttaagttgtatacatggcttcataaggcaacaataaacaagttaatatcgttttgt

SEQ ID NO: 966 - DNA, 370 bp, Ctenocephalides felis
  misc_feature (344)..(344): n = unknown
ggcaatggcagttgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaaagcaagtggatagaagaacgagcatgcttcatatggccataaccatatttccgtcgtgtgttgtgaaatgcaattatactttgagaaagtattatcaattcaaagaaaattcagaaagttgctactgaatcattttctaaaacatcgacatgaaaattaataactctttattgntattagattcgatgtaagatatatgt

SEQ ID NO: 967 - DNA, 416 bp, Ctenocephalides felis
ggtcgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgccagcgcacaacttcaaagtagaacaatcgtgacaaaatgtcccaactgcttattagt

SEQ ID NO: 968 - DNA, 379 bp, Ctenocephalides felis
  misc_feature (159)..(159): n = unknown
  misc_feature (211)..(211): n = unknown
  misc_feature (213)..(213): n = unknown
tatcttcatcgaatctaataacaataaagagttattaattttcatgtcgatgttttagaaaatgattcagtagcaacttctgaattttctttgtaattgataatactttctcaaagtataattgcatttcacaacacacgacggaaatatggttatggnccatatgaagcaatgctcgttcttctacccacttgcttctgataaatggtcngnataaagaatgcaatcactccacatgctatcagagatgttcctgatattaaaaatgttaaatcgcaattataatctagaattattcctacaacattgcttccaacaacacttctaatcgacccatcattaaagatatacatactgccattgcctgagttgtgtaggg

SEQ ID NO: 969 - DNA, 500 bp, Ctenocephalides felis
  misc_feature (374)..(374): n = unknown
  misc_feature (432)..(432): n = unknown
atgcacgctattcaaatttcacactgatctattaatacagtcttgaatcacatacagactcctcatatgtataatcacatataatgtttcataagccttaattgaaatggaatttaaattgaaatggtgatccatgatggaagtgatggaacggtgaaccaccgccccctctgtgattatttgcagattctggatctaaagggatcttcaccgttgtcaaactgagctcttttctcaggatcagtaagaacctctttagcagcagcaatatctataaatttattctctgctattttcttttcatcatctttgaaattatcaggatgccatttttgtgctgcttttcgataagctttaatgatctcttgctttgnagctggtctttttacacctagaattttataatagtctcttctctcagcttgcttttgnaacctctgagccttcaaaagcccatctttcgctctctgatcatgctcatttatttccaaagctgatta

SEQ ID NO: 970 - DNA, 341 bp, Ctenocephalides felis
  misc_feature (12)..(12): n = unknown
  misc_feature (288)..(288): n = unknown
ctttaaaattgnaacatctatatatatgaaatcatgatcggctccctggtttatttctatcgattactacagtattatatttataatatgttcaatatcgcactgtggtccaattttattttgaccaaaggtttatataagaatccaggttttcttgatcatgtaaaatgttggtccattatcttaaattaaaaaaattattatattcagaatgatatataatccattcaactttctaaaacgaacaagaaatctgcgccacgtctgatatctgtgaatatgtattgnatttaatatatatgttaagtgtttaaaaatatatttctatttcatatacttgt

SEQ ID NO: 971 - DNA, 447 bp, Ctenocephalides felis
  misc_feature (11)..(11): n = unknown
  misc_feature (76)..(76): n = unknown
  misc_feature (119)..(119): n = unknown
agctcttggtnttgaccttggcggcgcccggcagacacggtgcattgtattgcccaacataaattgatgggtccgngcatagttataaaagaattgggatttgtgcatttcatgacggngcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtcagcgcacaacttcaaagtagaacaatcgtgacaaaatgtcccaactgcttattagt

SEQ ID NO: 972 - DNA, 370 bp, Ctenocephalides felis
  misc_feature (11)..(11): n = unknown
  misc_feature (20)..(20): n = unknown
  misc_feature (36)..(36): n = unknown
  misc_feature (43)..(43): n = unknown
  misc_feature (172)..(172): n = unknown
  misc_feature (307)..(307): n = unknown
aaaagaattgngacttaggncctagaaatacaaagngtaaagntcaaggtttgtatagcttaataaagtaaacattttaaaatgtaatgaatttatctgcaaatagtcaaaatcaaaattactatataatgattattgaaataatgcttttatagattgcatttcaatctgnattaaattgtatgtaaatcacagcacaagatctaacacacaattcatctaacagaaagaacaaaataattttaatgttattaaaaattacatataaaataacttttacaataaagtaaccttacatgagatgtgntgatttcagatacttttcatacaacagtgctttctgtataaacaatataatataaataacggt

SEQ ID NO: 973 - DNA, 480 bp, Ctenocephalides felis
  misc_feature (357)..(357): n = unknown
cacaactcagggcaatgggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaaccgagcattgcttcatatggaccataaccatatttccgtcgtgtgttgtgaaatgcaattatactttgagaaagtattatcaattcaaagaaaattcagaagttgctactgaatcattttctaaaacatcgacatgaaaattaataactctttattgntattagattcgatgtaagatatatgtacatactcataggtaaaaaatgttaatgccgcaatgtcaaaattattaagagaataaataaatacttaaaatataaaaaaaaaaaaaaaaaaaaaaa

SEQ ID NO: 974 - DNA, 397 bp, Ctenocephalides felis
  misc_feature (27)..(27): n = unknown
  misc_feature (36)..(36): n = unknown
  misc_feature (64)..(64): n = unknown
  misc_feature (88)..(88): n = unknown
  misc_feature (127)..(127): n = unknown
  misc_feature (194)..(194): n = unknown
  misc_feature (230)..(230): n = unknown
  misc_feature (331)..(331): n = unknown
  misc_feature (355)..(355): n = unknown
gggggcctcttgggccaaaattcagcnggattccgnccccttcgaaaagccaattccaaaatgncaggtttggcccaattagacgccnagatccaagtcccagatgagaacatccataaatcaatcnaaggtgattaatttaaatatcattattggtgccaagaccattgtaataaaagataagaactttgtcntcagagtggacttgtcatggtgttgctaagattgtngtgtttattttgcatcacgtggagtgattgtagtttaagattaattctatttatttagtgtattgtgtatttatttttttaagatgcttaataggttgtcntattgtgagtcaagtgtaatggtncttgatccaattagaaattaaaaaaaaaaaaaaaaaaaaaaa

SEQ ID NO: 975 - DNA, 496 bp, Ctenocephalides felis
  misc_feature (36)..(36): n = unknown
  misc_feature (48)..(48): n = unknown
  misc_feature (104)..(104): n = unknown
tttaagccccttggttttggaccccggcttccgggnggccgcccgggnggggctaatagcaggtggggaacattttgcccgattgttctacttttgaagtgggngcgctgggacaagaaaccccaattacaacaatcaattgcagagactcaaattccgatgctccatttgtgtagatgatatgtgctcatcaaaacctgggggaaaactgtaagacgggcagaaactacatgcgcggttgtagggatatcaagccagatccgaaagactgccaagatacttattctgcaaagatggtaaaggtcagggtttttcgaatgcccacctaactatgtatatgatcattctaaaaatatgtgtaaaaagaaatcgtcagaagctgattgcaccgtcatgaaatgcacaaatcccaattcttttataacctatgcaccggcccatcaatttatgcttggtgcgatgacaaattgcaccgatcgtctgaaatgtcaaacca

SEQ ID NO: 976 - DNA, 373 bp, Ctenocephalides felis
  misc_feature (86)..(86): n = unknown
  misc_feature (88)..(88): n = unknown
  misc_feature (92)..(92): n = unknown
  misc_feature (127)..(127): n = unknown
  misc_feature (157)..(157): n = unknown
  misc_feature (247)..(247): n = unknown
  misc_feature (345)..(346): n = unknown
  misc_feature (358)..(358): n = unknown
taacatattttataattatggatttattcaaaattaatttaatccaagagcttatgaaattggatttatcttttatccatccagcncngaanggggataaaaaatacccatagaaatcttttcaggnatggccatttatacatttttttattacagncatcaaaaaaatagtatttctatgttatttttcaaaatctatacattgataagggttagaaatttgttcggttaattttcaggctgaggntgctactgtagtaatagaacaattttaataatctaaaatttgttaatctattcatttaatcattcaatagtaaatttccttttggaatttccaatggnnggcattacgggnaacaaaagcttctcg

SEQ ID NO: 977 - DNA, 328 bp, Ctenocephalides felis
  misc_feature (35)..(35): n = unknown
  misc_feature (66)..(66): n = unknown
  misc_feature (120)..(120): n = unknown
  misc_feature (132)..(132): n = unknown
  misc_feature (142)..(142): n = unknown
  misc_feature (198)..(198): n = unknown
  misc_feature (221)..(221): n = unknown
  misc_feature (295)..(295): n = unknown
tttttttttttttttttttttttttattgaacggnccaaacgatttatttttattaaaaagatacntgtaatttcataaagcttctatatttatatattttaaataatcagaaattactntagttaatgacnttttgtttgngctccttacataaaatacaattttatacattttaatttttatacatattttttatntttaattgcacacgatcatttgngtatttattatattaattgactactttatgataatttgaatcctaattagtctattcaagattgttttcctggnttaagccttacttagcaatctcacttttgcatt

SEQ ID NO: 978 - DNA, 498 bp, Ctenocephalides felis
  misc_feature (425)..(425): n = unknown
  misc_feature (479)..(479): n = unknown
  misc_feature (484)..(484): n = unknown
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgcttgtggccatttttgggtatctgtgctgaagtaataattttatgcgcgattattctcatttatgaaaagaaacgcacaaagctgaaatggaggagagtgatacagatcaaagtcagatcgaaaaaatcttctgatcacatgaaggacactgntgtgaggcattgaagtaacccaaaatttaatctagttggataaagttatgcccngagtngaagtatccaagag

SEQ ID NO: 979 - DNA, 122 bp, Ctenocephalides felis
taattaattttaaaaaattaaggatagaaaccaacctggcttaaaccggtttgaactcagatcatgtaagaattaatggtcgaacagaccaaattttaaaacttctgcattttaaaattatc

SEQ ID NO: 980 - DNA, 478 bp, Ctenocephalides felis
  misc_feature (10)..(10): n = unknown
  misc_feature (69)..(69): n = unknown
  misc_feature (127)..(127): n = unknown
  misc_feature (242)..(242): n = unknown
  misc_feature (313)..(313): n = unknown
tttttttttnctttaacggcccaaacgatttatttttattaaaaagatacatgtaatttcataaagctnctatatttatatattttaaataatcagaaattactatagttaatgacattttgtttgngctccttacataaaatacaattttatacattttaatttttatacatattttttatatttaattgcacagatcatttgtgtatttattatattaattgactactttatgataattngaatcctaattagtctattcaagattgttttcctggtttaagccttacttagcaatcccacttttgcattnttcgccgggtggcgtgggtatgcatcgcaactccgttttatcaaagtgcaagccatttggacaatcataatgtttatttgccatttgtgttaaccaagaaacattgataatattttttcaatctcttcgatcggaaaaaacgtttcacttttgctgcagttctgc

SEQ ID NO: 981 - DNA, 210 bp, Ctenocephalides felis
  misc_feature (13)..(13): n = unknown
ggaagcaccttangctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgt

SEQ ID NO: 982 - DNA, 385 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggacagaagaacgagcattgcttcatatggaccataaccatatttccgtcgtgtgttgtgaaatgcaattatactttgagaaagtattatcaattcaaagaaaattcagaagttgctactgaatcattttctaaaacatcgacatgaaaattaataactctttattgttattagattcgatgtaagatatatgt

SEQ ID NO: 983 - DNA, 167 bp, Ctenocephalides felis
  misc_feature (80)..(80): n = unknown
ctgcataccagtcagactgtttaggtgcaagtgtcacttcttccccatccataccatccttaccatccttaccatctttnccaaccttgccaacatcttccccaacagcaggatttccttttggccgaaaatctcttgatatgcaaacaaaaactggaactaaatgt

SEQ ID NO: 984 - DNA, 210 bp, Ctenocephalides felis; identical to SEQ ID NO: 416

SEQ ID NO: 985 - DNA, 481 bp, Ctenocephalides felis
  misc_feature (56)..(56): n = unknown
  misc_feature (195)..(195): n = unknown
  misc_feature (468)..(468): n = unknown
tttttttttacaaaggaacggcccaaacgatttatttttattaaaaagatacatgnaatttcataaagcttctatatttatatattttaaataatcagaaattactatagttaatgacattttgtttgtgctccttacataaaatacaattttatacattttaatttttatacatattttttatatttaattgcncagatcatttgtgtatttattatattaattgactctttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaccaagaaacattgataatattttttacaatctcttcgatcggaaaaacgtttcacttttnatgcagttctgca

SEQ ID NO: 986 - DNA, 360 bp, Ctenocephalides felis
tttgcagactgtactttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatcctctttatttactgttaaaggcgttccgcgacattaaactcaccatcataagcggtaacgacagataacgcccaaaactaataaaaaccaatgtgatataaaacattctaat

SEQ ID NO: 987 - DNA, 489 bp, Ctenocephalides felis
  misc_feature (28)..(28): n = unknown
  misc_feature (68)..(68): n = unknown
  misc_feature (137)..(137): n = unknown
  misc_feature (206)..(206): n = unknown
  misc_feature (244)..(244): n = unknown
  misc_feature (323)..(323): n = unknown
  misc_feature (340)..(340): n = unknown
  misc_feature (406)..(406): n = unknown
attttcctttaactttaatgagaatggncatatcagtaagatctttaccatcccatttatcaaatggntccaacaattgcaatcggtctgatttaggatcaacattaactttcacacttgaaccatctgcaggaggntgttcatatgtatcttgacctgcatcgaaacctttgcttggaagttcatcgccaaagggtgaatcaagnttgaattctttgccatcgcttcctttcagagtatctgntactggattaaaatctaagcggccagcaattgatagagctgtgactaattcaggacttgtgacaaaacagtgagtggcnggattagcatcattacngcctgtgaaatttctattatatgaagtaacaattgggttttctctctttcttcacatccttacgancccactgccgatgcaaggccacaggcattggcttaaacagtgccccaaattcaccggagaggttgggcaattccatctcgttc

SEQ ID NO: 988 - DNA, 500 bp, Ctenocephalides felis
cactgatttggcccaatttatgaacgtgctggacgtgttgaaggcagaaatggttctatcacccaaattccaattttgactatgcccaacgatgatattactcaccctattcctgatttgactggttacatcactgaaggacagatctacgtagacagacaactgcacaacaggcaaatctacccacctgtaaacgtattgccttccctgtcacgtttgatgaaatctgccattggtgagggtatgacacgtagagatcactctgatgtgtccaatcaattgtatgcttgctacgccattggtaaggacgtgcaggctatgaaggctgtcgtaggagaggaagctttgacacctgatgacttgttgtacttggaattcttgacgaaatttgagaagaactttatctcacagggtaattatgagaacccgcacagtatttgaatctttggacattggctggcaattgttgcgtatcttcccaaggagatgttgaagagaat

SEQ ID NO: 989 - DNA, 374 bp, Ctenocephalides felis
  misc_feature (78)..(78): n = unknown
  misc_feature (244)..(244): n = unknown
  misc_feature (246)..(246): n = unknown
  misc_feature (315)..(315): n = unknown
ttttttttttttttttttttttcattaagcttgtatgtaatatgcaatagcaatttcatataacacactcactaggtncatgtagaatttaaatcgtctttagaaacttctccttttgtacatttagttccagtttttgtttgcatatcaagagattttcggccaaaaggaaatcctgctgttggggaagatgttggcaaggttgggaaagatggtaaggatggtatggatggggaagaagtgncncttgccctaaacagtctgattgatatgcaggtacgcactgctgcagaacgctgttgaaatataactcanctgcacaagcatatcgggcccgtcgaatacaccttgagcgtttaatgtgcactcgtagt

SEQ ID NO: 990 - DNA, 498 bp, Ctenocephalides felis
  misc_feature (490)..(490): n = unknown
agattgccaggtttttatatactacaatactaaattatttaaaaaggccattttcaactcctaataaaagtatttgagcaccactctttctgcagaaagattaaattaaagttgttcaaaaggtagtcggtgttatagagctacattacatttttaaatcttcgtgttgaaaaagtgggtgctgttgctcaaaatatttttttcagagtttaaggattgagagaagcacattagcccgtatagaccttacacagcaaaagtgttgaataaaatgcatgtttcagaaaattatgatttagaccaattaagtattcgaaaatttcaaatgtaatattcatcattcaattatagcatgctatataacttctacggaatgtgcatctattaacatttttaaaataggactatgaagcaaagtggaagcatcaattatatgaactattgctgaaaaatgtgatcatgccaaaacactcattatgaatctgattgngcattcat

SEQ ID NO: 991 - DNA, 330 bp, Ctenocephalides felis
  misc_feature (31)..(31): n = unknown
ttttttttttttttttttttttttttgattnatttataaataactttaggtgtccgccactaggggacttccccctacatttagaagtccgtattatttcttacttttaattttattttcttcatttttatattaactctatatctttatctatctatctattagttcaaccaataaaattaagcgtaaaatgaataattttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 992 - DNA, 451 bp, Ctenocephalides felis
  misc_feature (211)..(211): n = unknown
tttttttgggcatttttaatttatttcatcaactacattgaaattaaacaaataaagaactattattcttaaattaaagggaaattttacatcatacattcaacatgaatcaattctaaaattatgtgaataaccaaaattttaaaccattaacacaaatattttttattcccacttaacttattacttattaaaatattacttggcaagnatttttatattttgtatttttttaggtatattataaagacgcctttagttgttgccttatgaataaaatacatatttataatacattcacatattatatactaaactattgagaagacttagacgatttaatggaattaatatgaaggaatttattaatttaaattttataaatataaaaaattttaggctttttttaagatatcctatgttatattataattcgttttcattacagatg

SEQ ID NO: 993 - DNA, 498 bp, Ctenocephalides felis
  misc_feature (335)..(335): n = unknown
  misc_feature (349)..(349): n = unknown
  misc_feature (357)..(357): n = unknown
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgntaacattttattgntgaatggntaaaagataaatacaattttataagctggttggataaattaattttgaataaatcataatcatagaatatgttaagtagcaaattaaaatatggccacaaaccaccaaatgtatcgaaatattacttatatgattatgaaa

SEQ ID NO: 994 - DNA, 500 bp, Ctenocephalides felis
  misc_feature (14)..(14): n = unknown
  misc_feature (33)..(33): n = unknown
  misc_feature (45)..(45): n = unknown
  misc_feature (51)..(51): n = unknown
  misc_feature (111)..(111): n = unknown
  misc_feature (179)..(179): n = unknown
  misc_feature (326)..(326): n = unknown
  misc_feature (336)..(336): n = unknown
  misc_feature (350)..(350): n = unknown
  misc_feature (454)..(454): n = unknown
  misc_feature (460)..(460): n = unknown
  misc_feature (468)..(469): n = unknown
  misc_feature (471)..(471): n = unknown
  misc_feature (490)..(490): n = unknown
  misc_feature (493)..(493): n = unknown
  misc_feature (498)..(498): n = unknown
  misc_feature (500)..(500): n = unknown
ccaggagactttgnttaccggaatggacaaccnttcgaaattccnaaaggnaatttactattggatgattaaatgtaatagattaatcaaattttagatgattaaaattgntctattactacaatagcaacctctgcctgaaaattaaccgaacaaacttctaacatccttattaatgnatagattttgaataataacatagaaattatactatttttttgatgactctaataaaaaaaatgtataaatggccatgcctgatatatttttgataaccttaatgaaaaaatgtttaaatggccatgtctgaaaagatttctatgtgnatttttttgntaacattttattgntgaatggataaaagataaatcaattttataagctgtttggataaattaattttgaataaatcataatcatagaatatgttaagtagcaaattaaaatatggccncaaccnccaaatgnntncgaaatataacttatatgnttntgaanan

SEQ ID NO: 995 - DNA, 165 bp, Ctenocephalides felis
  misc_feature (54)..(54): n = unknown
gggtaacatatttattagaatgttttatatcacattggtttttattagttttgnggcgttatctgtcgttaccgcttatgatggtgagtttaatgtcgacggaacgcctttaacagtaaataaagaagtatttgcatcattggatgaacccgcaccaggagtagt

SEQ ID NO: 996 - DNA, 484 bp, Ctenocephalides felis
  misc_feature (115)..(115): n = unknown
  misc_feature (226)..(226): n = unknown
tttttttttggatttcataaagcttctatatttatatattttaaataatcagaaattactatagttaatgacattttgtttgtgctccttacataaaatacaattttatacattntaatttttatacatattttttatatttaattgcacagatcatttgggtatttattatattaattgactactttatgataatttgaatcctaattagtctattcaagattgntttcctggtttaagccttacttagcaatctcacttttgcattcttcgccgggtggcgtgggtatgcatcgcaactccgttttatcaaagtgcaagccatttggacaatcataatgttttatttgccatttgttggtaaccaagaaacattgataatattttttacaatctcttcgatcggaaaaaacgttttcacttttgcatgcagttctgccgagaaaagaatttgggcaaaccattcggtgacgcgcttcacatt

SEQ ID NO: 997 - DNA, 496 bp, Ctenocephalides felis
aatgtgaagacgacgtcaacgaatgggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacaccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgcattaactatagtaatttctgttatttaaaatatataaatatagaagctttatgaaattaaaaaaaaaaaaaaaaaaaa

SEQ ID NO: 998 - DNA, 357 bp, Ctenocephalides felis
  misc_feature (24)..(24): n = unknown
  misc_feature (36)..(36): n = unknown
  misc_feature (44)..(44): n = unknown
  misc_feature (49)..(49): n = unknown
  misc_feature (51)..(51): n = unknown
  misc_feature (104)..(104): n = unknown
  misc_feature (144)..(144): n = unknown
  misc_feature (153)..(153): n = unknown
  misc_feature (168)..(168): n = unknown
  misc_feature (170)..(170): n = unknown
  misc_feature (175)..(175): n = unknown
  misc_feature (185)..(185): n = unknown
  misc_feature (200)..(200): n = unknown
  misc_feature (225)..(225): n = unknown
  misc_feature (228)..(228): n = unknown
  misc_feature (342)..(342): n = unknown
gcagactgtactttctttagtggngcactgtaaatntccacttngatcngngcacacttgatctgggctacaggattccttaaccggatctgctcctatttccngacaatactgcatttcgggtgaactgcacgaattcacgcnactaaattntacttttttacattntngctcnggtttcggtncaggtgtaggttcangaggaggtactactcctggtgcggnctnatccaatgatgcaaatcctctttatttactgttaaaggcgttccgcgacattaaactcaccattatagcggcaacgacggataacgccacaaaactaataaaaaccaatggganataaaacattctaat

SEQ ID NO: 999 - DNA, 405 bp, Ctenocephalides felis
  misc_feature (404)..(404): n = unknown
atggaatagtgctaaccaaagcaaagataaaccaatctcgcgtcgcccacatcagtaacggcataagaatcattccactggtccacccgatggactgcatcatggcaatgtgtgctctatcttcacttctggatatttccatcgcaattatcaaagggctttgaaaaacagatgtagatgttagtgaaccaagaaaagccgctgttataaaaacaataaaccaactggaagtaaatgctgtaattagtcttccggtgacgattgtgatgagacttaagtaaaatactggtcttcttccaatcctgtctcctaattgaccaaagataaatgtacctatgacttcgcctgcacgtcctatagcaaatgtattagttacatacagttctctatcaaggacggggggng

SEQ ID NO: 1000 - DNA, 493 bp, Ctenocephalides felis
  misc_feature (145)..(145): n = unknown
  misc_feature (223)..(223): n = unknown
  misc_feature (420)..(420): n = unknown
tttttttttttttttttttttttttacaaaggaacggcccaaacgatttatttttattaaaaagatacatgtaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatcccacttttgcattcttcgccgggtggcgtgggtatgcatcgcaactccgttttatcaaagtgcaagccatttggacaatcataatgttttatttgccatttgntggtaaccaagaaacattgataatattttttacaatctcttcgatcggaaaaaacgttttcacttttgcatgc

SEQ ID NO: 1001 - DNA, 251 bp, Ctenocephalides felis
aataaatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagt

SEQ ID NO: 1002 - DNA, 360 bp, Ctenocephalides felis
  misc_feature (66)..(66): n = unknown
ctgataattgcctgcaagaatgagtttcagggaacgaaaagaatcggccaaatgcatgcaaaaggntgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatcataatctaataaaccagcaagtgaacttcaaaaaaaaaaaaaaaaaaaaaaaaaaa

SEQ ID NO: 1003 - DNA, 383 bp, Ctenocephalides felis
  misc_feature (25)..(25): n = unknown
  misc_feature (29)..(29): n = unknown
  misc_feature (151)..(151): n = unknown
  misc_feature (248)..(248): n = unknown
  misc_feature (357)..(357): n = unknown
cctcacaactcagggcaatggcagnatgnatatctttaatgatgggtcgattaggaagtgttgttggaagcaatgttgtaggaataattctagattataattgcgatttaacatttttaatatcaggaacatctctgatagcatgtggagngattgcattctttataccgaacatttatcagaagcaagtggatagaagaacgagcattgcttcatatggccataaccatatttccgtcgtgtgttgngaaatgcaattatactttgagaaagtattatcaattcaaagaaaattcagaagttgctactgaatcattttctaaaacatcgacatgaaaattaataactctttattgntattagattcgatgtaagatatatgt

SEQ ID NO: 1004 - DNA, 407 bp, Ctenocephalides felis
aacatatttatataagttttttccctgtaaatagtaaatatgaattttgtttgagaaaatagttgcatgtgtatcatgttaaacaaaatctatgtgaacttcttgattaatttaatcacttatttatatttgcacgcgttgataatatttaagatatgaaatctatagaagcgatcctttgtatgacaaagttgacattgttaatcatatataccaatgatttgcgacatatgttatggtgctatttgtcccttaaaaatctacatgtgtagtgaatttgttctgcttctacgttgataaatgcttggatatagtgttttgaatactttttataaatatacatatatattgaattaaacaatcaaaagaaataaaaatgtaaaaaaaaaaaaaaaaaaaaaaaaaaa

SEQ ID NO: 1005 - DNA, 500 bp, Ctenocephalides felis
  misc_feature (31)..(31): n = unknown
  misc_feature (413)..(413): n = unknown
tttttttttttttttttttttttcggcccanaccgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgntaaccaagaaacattgataatattttttacaatctcttcgatcggaaaaaacgtttcacttttgcatgcagtctgcacgagaaagat

SEQ ID NO: 1006 - DNA, 212 bp, Ctenocephalides felis
aagggtttcaaatgtccgtcaccatcgagattttatccaaatataaatggattgtcaaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgctttcgt

SEQ ID NO: 1007 - DNA, 378 bp, Ctenocephalides felis
  misc_feature (24)..(24): n = unknown
  misc_feature (64)..(64): n = unknown
  misc_feature (85)..(85): n = unknown
  misc_feature (180)..(180): n = unknown
  misc_feature (197)..(197): n = unknown
  misc_feature (206)..(206): n = unknown
  misc_feature (217)..(217): n = unknown
  misc_feature (227)..(227): n = unknown
  misc_feature (305)..(305): n = unknown
tatataatctgattctcgatttgnatcttcataactgattctcagatatccattaccggaatgntcatcattacgtctgagttgnccactaaattcaactttttttccattttcttccatgacatgtctgaattttattttaccatcaactaaagattccatgtgagctcttgcgcaagntccatctcgttcaaaangattttggnatctatattgntcgtccaagntcccaaatattctttcatttcaaatttttccataggaaccgctttaggacaaagactttgtccaagattttgccgaancaaaatgcaatgcacacaaaataaatcgtgatttttgcatttttagggtgaaaatattttaaactgtgattct

SEQ ID NO: 1008 - DNA, 210 bp, Ctenocephalides felis; identical to SEQ ID NO: 416

SEQ ID NO: 1009 - DNA, 498 bp, Ctenocephalides felis
aataaatcatggtctgaagagacaaataagattgaaagtcaaataataccttgtcagcatggttatgaatatgacagaacatggtatttatcaacggctccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgtcaccggaagactaattacagcatttacttccagttggtttattgtttttataacagcggcttttcttggttcactaacatctacatctgtttttcaaagccctttgataattgcgatggaaatatccagaagtgaagatagagcacacattgccatgatgcagtccatcgggtggccagtggaatgattcttatgccgtactgtgtgggcgacgcgagattggttatctttgctttggtag

SEQ ID NO: 1010 - DNA, 264 bp, Ctenocephalides felis
  misc_feature (76)..(76): n = unknown
  misc_feature (119)..(119): n = unknown
  misc_feature (157)..(157): n = unknown
  misc_feature (172)..(172): n = unknown
  misc_feature (178)..(178): n = unknown
  misc_feature (198)..(198): n = unknown
  misc_feature (241)..(241): n = unknown
acacaggctcgcaaatatgataaggcatttaagaattttacaatttagatttttttaaatccatgaatatatttgntctaatcaaaattattcattttacgcttaattttattggttgnactaatagatagatagataaagatatagagttaatatnaaaatgaagaaaatnaaattnaaagttagaaataatacggncttctaaatgtagggggaagcccctagtggcggcacctaaagntatttataaataaatcaaaaaat

SEQ ID NO: 1011 - DNA, 404 bp, Ctenocephalides felis
  misc_feature (40)..(40): n = unknown
  misc_feature (205)..(205): n = unknown
agatctactaatgccgcgtttaccactgtcacagcaattncgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatncagctttcaacattaaagaatgcataaatgcctgttcttccattgtgtctttacactcggtcgtactattcgtagtatcaatgaagtcgtccgcctaagcattgatgaattttggacaacgtagcatattgtacttggtactcctggatgagcgttttgaaattctgcattttacttatgatatcgggaaaccacatgt

SEQ ID NO: 1012 - DNA, 294 bp, Ctenocephalides felis
ctatattctggctttctaaatactccatgccgtcaataatctgccgacaatatgtagggaaaagttcttcgtctataataatattctctttctctcttaaataatgcaacaaaatgtagtctagtttttcagtaatgatgtaatgttttggagtttcgatccaggcaagaacttgctgtatatttggatgtttcagtgatttacttaaatttatctctcttttaaaattttcatgttcttgactttccacgccatctattgtggttgttaccaagagtggctttctcgaaatgt

SEQ ID NO: 1013 - DNA, 500 bp, Ctenocephalides felis
ccaatttgaatatattgtaagacaattgcaattatatttcaacaactgtattagttaccgaatataatttataggattcataaaaactaattgtgttcaattatcattcacaatattcataaataagcaaataaattattcaataaaatatataaaattgatgtttctgtaacatatatactataagataataataggattgttagaaaactttaaattaaagtgaagtctatttctttagttctttaaggtgcttgcatttagatcaatttcaagactattctcaggactagaattcaattggacattattgatctctgcacgatgttttccatcagagacagtcgttacgcttctgtaaaatgaggaccaagcgggcatttgattgttgttagtgtcgcattctgaacttcaaatttgttgccggcgtatcgctaactcacgaagtatttcgtaatttccttggtgcatttatctaattcttctattgtttagcattg

SEQ ID NO: 1014 - DNA, 95 bp, Ctenocephalides felis
  misc_feature (27)..(27): n = unknown
tacgagtgcacattaaacgctcaaggngtattcgacgtggcccgatatgcttgtgcagctgagttatatttcaacagcgttctgcagcagtgcgt

SEQ ID NO: 1015 - DNA, 498 bp, Ctenocephalides felis
  misc_feature (20)..(20): n = unknown
  misc_feature (34)..(34): n = unknown
  misc_feature (48)..(50): n = unknown
gaggagacttgtttccgttntggcaaccattcgnaattccaaaaggannngtactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctggttggataaattaatttgaataaatccataatcatagaatatgttaagtagcaaattaaaatatggacccaaaccacaaaatgtatacgaaatataacttatatgatatatgaaaa

SEQ ID NO: 1016 - DNA, 445 bp, Ctenocephalides felis
caggtgcgttcatatctgaattttttttgttgaattatttttaatgtaataaatcatagtaatatttatttccaatttgcaaatatggaaactaccatccctatattatatataattgtatatattcctgaattgttttatttgaatttattttaaacacaaactttaattatattcaaataatgatggatgtgatttcatatatccctaaactttggatcagagtttgagagaagcctagccatagtgtatagaaaattatgtgtaggtgtataattaagattgcaggagtcaaatatataaagcattgatacaaattatacattccaattttctgtaaaccgtgttctttggttgattatggtttatatcacaatttatgaatcatgtaaattaattgtaaatttgaaatgtatctccgtgcaaaaaaaaaaaaaaaaaaaaa

SEQ ID NO: 1017 - DNA, 210 bp, Ctenocephalides felis
  misc_feature (5)..(5): n = unknown
  misc_feature (47)..(47): n = unknown
  misc_feature (106)..(106): n = unknown
  misc_feature (196)..(196): n = unknown
ttttnaagtgcaacccaatcattagggaaccgctaacagaagttatnacagtgacgttctacatcggagaatggttagaattcaaaaaataatcatgcaacacggnctcattattataacattcacataaaaaatatttaaaatatgtaaactagcttgcatgtttattgtaagccagtctataatctattattgnttgcactttactta

SEQ ID NO: 1018 - DNA, 211 bp, Ctenocephalides felis
  misc_feature (1)..(1): n = unknown
  misc_feature (17)..(18): n = unknown
  misc_feature (46)..(46): n = unknown
  misc_feature (91)..(91): n = unknown
  misc_feature (172)..(172): n = unknown
  misc_feature (189)..(189): n = unknown
ngaagcaccttaagctnngcaggacatgtaactgtatagcattttntgcccagagccataagtccgcaattatgacgtaacggatcatatncaaaatttgcggggcaataatattgggttcctatactattttcgtcacaataataatagctttgacaatcatttatatttngataaaatcttgatggngacgggcattttaaaaccttgt

SEQ ID NO: 1019 - DNA, 361 bp, Ctenocephalides felis
ttttttttttttttttttttttgagcagataaaaaaatatattaatttaataatatataatagtaacatataaagaatacattgatttaacaattgataatcatattcacataacacataattataagctatcgtaatttttagaaaatgagttgactttaaatataaatacacaaattttcatatttttaagaacacaattatgttcaagaacttcacatatcaagatactacctcagctttacagcataattggggatcttctatatcttttttactttggattaattttagctcaatatatttcatgttggaagtatcacctccagctaagtttgaatattctagagttcgttttagt

SEQ ID NO: 1020 - DNA, 481 bp, Ctenocephalides felis
  misc_feature (12)..(12): n = unknown
  misc_feature (128)..(128): n = unknown
  misc_feature (204)..(204): n = unknown
  misc_feature (334)..(334): n = unknown
  misc_feature (387)..(387): n = unknown
  misc_feature (403)..(403): n = unknown
tttttttttttnttgtacggcccaaacgatttatttttattaaaaagatacatggaatttcataaagcttctatatttatatattttaaataatcagaaattactatagttaatgacattttgtttgngctccctacataaaatacaattttatacattttaatttttatacatattttttatatttaattgcacagatcattngggtatttattatattaattgactactttatgataatttgaatcctaattagtctattcaagattgttttcctgggttaagccttacttagcaatctcacttttgcattcttcgccgggtggcgtgggtntgcatcgcaactccgttttatcaaagtgcaagccatttggacaatcataatgntttatttgccatttgntggtaaccaagaaacattgataatattttttacaatctcttcgatcggaaaaaacgttttcacttttgcatgcagttc

SEQ ID NO: 1021 - DNA, 408 bp, Ctenocephalides felis
  misc_feature (25)..(25): n = unknown
  misc_feature (78)..(78): n = unknown
  misc_feature (103)..(103): n = unknown
  misc_feature (117)..(117): n = unknown
  misc_feature (142)..(142): n = unknown
  misc_feature (166)..(166): n = unknown
  misc_feature (207)..(207): n = unknown
  misc_feature (295)..(295): n = unknown
  misc_feature (385)..(385): n = unknown
tttttttttttttttttttttttgnccaaacagcttataaaaatggatttatcttttatccattcaacaataaaatgntaacaaaaaaatacacatagaaatnttttcagacatggncatttaaacattttttcattaaggntatcaaaaatatatcaggcatggncatttatacattttttttattagagtcatcaaaaaaatagnataatttctatgttattattcaaaatctatcattaataaggatgttagaagtttgttcggttaattttcaggcagaggttgctattgnagtaatagaacaattttaatcatctaaaatttgattaatctattcatttaatcattcaatagtaaatttccttttggaatttcgaatggntgccattacgggaaacaaagtct

SEQ ID NO: 1022 - DNA, 498 bp, Ctenocephalides felis
  misc_feature (60)..(60): n = unknown
  misc_feature (141)..(141): n = unknown
  misc_feature (200)..(200): n = unknown
  misc_feature (224)..(224): n = unknown
  misc_feature (449)..(449): n = unknown
  misc_feature (452)..(452): n = unknown
  misc_feature (478)..(478): n = unknown
ttagactacaaatcttttttaagaaaatacgcagaaaaatagccttacatattcgactgnttatacttgtgacaagtttaaaggatttaatttaagcgacttctgtatttatgtaattcacctactctaaattaagactgnaatttatcattatctgacatagttttttggttttacgtattttttattaaaattcttgngaagttcaacaagtagaatattgnttttttaattgggttatttggaccttagaatattctaaaatactctatttacatagagagagcaagatgcttaaatttatacaatatgtcgagtaaaaccaaaaaaaacgtaaacttgcatgctttctagacatgctgctataatcataaaaaacagttttgtccatcttgaaataagtcagatcttatattatatacattaataatggatcgatcacatattgntgnatcattgaaatgaaataattcagggnggaaatataattttcctata

SEQ ID NO: 1023 - DNA, 328 bp, Ctenocephalides felis
  misc_feature (20)..(20): n = unknown
  misc_feature (22)..(22): n = unknown
  misc_feature (25)..(25): n = unknown
  misc_feature (36)..(36): n = unknown
  misc_feature (40)..(40): n = unknown
  misc_feature (75)..(75): n = unknown
  misc_feature (79)..(79): n = unknown
  misc_feature (110)..(110): n = unknown
  misc_feature (131)..(131): n = unknown
  misc_feature (136)..(136): n = unknown
  misc_feature (149)..(149): n = unknown
  misc_feature (232)..(232): n = unknown
  misc_feature (234)..(235): n = unknown
  misc_feature (246)..(246): n = unknown
  misc_feature (270)..(270): n = unknown
ttgcactttgataaaacggngntgngatgcatcccncccnccccgcgaagaatgcaaaagtgagattgcttagtnaggnttaaaccaggaaaacaatcttgaatagactnattaggattcaaattatcatnaagtngtcaattaatatnataaatacacaaatgatctgtgcgattaaatataaaaaatatgttttaaaattaaaatgttaaaattgtgttttatgttaggngnncaaacaaaagncattaactatagtaatttctgttnttttaaatatataaatatagaagctttatggaatcaaaaaaaaaaaaaaaaaaaaaaa

SEQ ID NO: 1024 - DNA, 358 bp, Ctenocephalides felis
  misc_feature (126)..(126): n = unknown
  misc_feature (153)..(153): n = unknown
  misc_feature (217)..(217): n = unknown
  misc_feature (272)..(272): n = unknown
  misc_feature (288)..(288): n = unknown
  misc_feature (299)..(299): n = unknown
tattaatgagacttatgacgaatcatccgatcgaatcaaattgttagatcatgacaatataccaaattctgctttggaaattgatttggctgaaaaaagcgatcgaggagaatatacatgtattgntactaatcaaggcattggaattactgntaattctacaaccttggttcgagttcaagataaattagctgctctgtggccatttttgggtatntgtgctgaagtaataattttatgcgcgattattctcatttatgaaaagaaacgcnacaaagctgaaatggnggagagtgatncagatcaaagtccagatcgaaaaaatactcctgatcacatgaaggacactgatgtgagg

SEQ ID NO: 1025 - DNA, 269 bp, Ctenocephalides felis
  misc_feature (45)..(45): n = unknown
  misc_feature (77)..(77): n = unknown
  misc_feature (83)..(83): n = unknown
  misc_feature (102)..(102): n = unknown
  misc_feature (105)..(105): n = unknown
  misc_feature (118)..(118): n = unknown
  misc_feature (123)..(123): n = unknown
  misc_feature (144)..(144): n = unknown
  misc_feature (163)..(164): n = unknown
  misc_feature (167)..(167): n = unknown
  misc_feature (187)..(187): n = unknown
  misc_feature (212)..(212): n = unknown
  misc_feature (240)..(240): n = unknown
  misc_feature (253)..(253): n = unknown
agatctactaatgcccgcgtttaccactgtcacagcaattccgcnaaccagcaaccacaaatattaatatgatgctnttgttnaatgttcaataaatgcacnaantattccacaaatnccgcntgagaccatcacgaatacaanaattggaagctttcccacnnagntaataatagcacctattatnggaaatcaatcgcatattcagcttncaacattaaagaatgcataaatgcctgntcttccattgtgnctttacactcgggcgt

SEQ ID NO: 1026 - DNA, 305 bp, Ctenocephalides felis
  misc_feature (35)..(35): n = unknown
  misc_feature (37)..(37): n = unknown
  misc_feature (40)..(40): n = unknown
  misc_feature (76)..(76): n = unknown
  misc_feature (148)..(148): n = unknown
  misc_feature (170)..(170): n = unknown
  misc_feature (281)..(281): n = unknown
cctttttattggctgggataaggaactaaaaaggntngtnagggtggcagataaaattggagaggctggtctgganaaactcctaaattaatggataaaattgagagatttgttgataggaaaattggcaaaagcagaagaattgctnaagaaaaatcaaagaaaagccnaaaaatggtatcaccgtcttacaggtgaaagaaaaatttaaattgcaagaaatacatatttttataggagcatttgcagctggtgctgctttgggtattgcagctgcttangaaaagcacacattttgatgtagt

SEQ ID NO: 1027 - DNA, 262 bp, Ctenocephalides felis
  misc_feature (160)..(160): n = unknown
  misc_feature (235)..(235): n = unknown
  misc_feature (241)..(241): n = unknown
ccgggcaggtactacttcatgtattaagcattttgtatgaatattatgtagtcgatgtgtctctaatatattactggtgagcaacatatttttatagataagagtagatgtaataattcattttaagaattgagttactagaattattctattatgctgnattatatgttaatataactatattaaaagaaaaattattaatattaatgcatcttttaataaactggaaagaacngcgganaaaaaaaaaaaaaaaaaaaaa

SEQ ID NO: 1028 - DNA, 131 bp, Ctenocephalides felis; identical to SEQ ID NO: 515

SEQ ID NO: 1029 - DNA, 262 bp, Ctenocephalides felis
  misc_feature (8)..(8): n = unknown
  misc_feature (40)..(40): n = unknown
  misc_feature (42)..(45): n = unknown
  misc_feature (55)..(55): n = unknown
  misc_feature (120)..(120): n = unknown
tttttttntttttttttttttttttttgcttcttactttnannnntattttcttnatttttatattaactctatatctttatctatctatctattagttcaaccaataaaattaagcgtnaaatgaataattttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 1030 - DNA, 407 bp, Ctenocephalides felis
tagtgctagatatagttctttgaacagatgcaaaatagtctcgttcacgcctcagttctaaattctcagcgagcaattcttgaatgcgagcggcctgctcttgtagcttctcacttgttgcagcatcacactcattaccagattgtttgtgcattctttcagattttgcatttctaatagtttttgtgagatgatctagacgagattccatgagaatacattcttgaattagttcatttttagtcatagcattaagtctttcacattgagcatcttcatagacactagaaaattcttttattaggaaatcttcctcatcttcaggtaaagacatgaagtagttgtcttcagaatcgacactaaagctagagtctcgagttctggcagatggaatccttggttgaggt

SEQ ID NO: 1031 - DNA, 259 bp, Ctenocephalides felis
  misc_feature (26)..(26): n = unknown
cccatttttaatgaaatcctatcctncggttctaacgtgaatatcactcctgtagcagttcctatggataatagaagtcccattagggacatagagccacgaatttccatttaaatatatgtatttatctttaaataaaataaaacaataatttggtcaattttaattctcatagcatcagcagtttcataactgtaattaaatcatcaataatggctggtgacaacaaatgggatatttacagtttttacaccattgt

SEQ ID NO: 1032 - DNA, 166 bp, Ctenocephalides felis
  misc_feature (3)..(3): n = unknown
  misc_feature (11)..(11): n = unknown
  misc_feature (35)..(35): n = unknown
  misc_feature (43)..(43): n = unknown
  misc_feature (67)..(67): n = unknown
  misc_feature (100)..(100): n = unknown
  misc_feature (123)..(123): n = unknown
  misc_feature (135)..(135): n = unknown
  misc_feature (143)..(143): n = unknown
ctncataccantcagactgtttaggtgcaagtgtnacttcttncccatccataccatccttaccatncttaccatcttttccaaccttgccaacatcttncccaacagcaggattttcttttngccgaaaatctnttgatatncaaacaaaaactggaactaaatg

SEQ ID NO: 1033 - DNA, 484 bp, Ctenocephalides felis
  misc_feature (201)..(201): n = unknown
  misc_feature (322)..(322): n = unknown
  misc_feature (401)..(401): n = unknown
tttttttttttacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggngtgggtatgcatcgcaactccgttttatcaaagtgcaagccatttggacaatcataatgttttatttgccatttgttgntaaccaagaaacattgataatattttttacaatctcttcgatcggaaaaaacgttttcacttttgcatgcagttctgccgaga

SEQ ID NO: 1034 - DNA, 446 bp, Ctenocephalides felis
  misc_feature (47)..(47): n = unknown
  misc_feature (81)..(81): n = unknown
  misc_feature (135)..(135): n = unknown
  misc_feature (195)..(195): n = unknown
  misc_feature (218)..(218): n = unknown
  misc_feature (260)..(260): n = unknown
  misc_feature (268)..(268): n = unknown
  misc_feature (309)..(309): n = unknown
  misc_feature (411)..(411): n = unknown
gaactgcatgccaaagtgaaaacgttttttccgatcgaagagattgnaaaaaatattatcaatgtttcttggttaacaacnaatggcaaataaaacattatgattgccaaatggcttgcactttgataaaacggngttgcgatgcatacccacgcccccggcgaagaatgcaaaagtgagattgcttagtaaggnttaaaccaggaaaacaatcttgnatagactaattaggattcaaattatcataaagtagtcaattnatataatnaataccaaatgatctgtgcaattaaatataaaaaatatgtntaaaattaaaatgtataaaattgtttttatgtaagggcacaaacaaaatgcattaactatagtaatttctgattatttaaaatatataaatatagaagcttntgaaattaaaaaaaaaaaaaaaaaaaaaaaaaaaa

SEQ ID NO: 1035 - DNA, 412 bp, Ctenocephalides felis
  misc_feature (29)..(29): n = unknown
  misc_feature (65)..(65): n = unknown
  misc_feature (139)..(139): n = unknown
  misc_feature (149)..(149): n = unknown
  misc_feature (163)..(163): n = unknown
  misc_feature (177)..(177): n = unknown
  misc_feature (202)..(202): n = unknown
  misc_feature (235)..(235): n = unknown
  misc_feature (250)..(250): n = unknown
  misc_feature (352)..(352): n = unknown
  misc_feature (401)..(401): n = unknown
  misc_feature (403)..(403): n = unknown
ttattcttaaattaaagggaaattttacntcatacattcaacatgaatcaattctaaaattatgngaataaccaaaattttaaaccattaacacaaatattttttattcccacttaacttattacttattaaaatattncttggcaagnatttctatattttnggatttttttaggnatattataaagacgcctttagttgnttgccttatgaataaaatacatatttataatcnttcacatattatttnctaaactattgagaagacttagacgatttaatggaattaatatgaaggaatttattaatttaaattttataaatataaaaaattttaggctttttttaaganatcctatgttatattataattcggtttcatttacagatgtggcatatangnatatttttg

SEQ ID NO: 1036 - DNA, 498 bp, Ctenocephalides felis
  misc_feature (15)..(15): n = unknown
  misc_feature (25)..(25): n = unknown
  misc_feature (62)..(62): n = unknown
aaataaatagttcgntatttattgntcttagaataaatattattcatgcttatttgtatggntagttgtaatatctgaatatatattttgcaatagtgcacttttcaagtaattttagattagtttattattattattatttttattcttgaactatttcaaatgggttacttagataaagtattatgacttgactgtataatcaaccgaataaaaggaatgttatctgaaacgcatggatttataataattttcaaatataaataaatattaaatattatgcacaaataaatatagaatttcacctacatatgtttacctactggattttgaaaatatatttttgtattttacgaaaaaaggtatcgtttcgagtcattttataactatggtctcataaaattggcaaaatattcaggtaaaatctggttgctccgctctccgccagaactgcggacatcattttagtcgcctgaactattaatttttatcatttta

SEQ ID NO: 1037 - DNA, 372 bp, Ctenocephalides felis
aaaatccatttaatgaacatcatgaacaccatgttggccaagagaagaactaagaagaccaattggggcaagaattctactaatatgctgatcttctggcggaaatgaacgtgattgaaaacggccatgcaaactccaaaaatcatgtgaacgacgccgaaaatgatagacaacttcattttgaaggagttcaagaaaataattttgttggtagccagctgcccattggatctaaaccaataggatatgcttctccagcatctgtttttgggtcaagagttaattcttcattctccatcacagtggatgaattataatttaatgtccatccagaaccaaaaatgttcatggataaggagaaaatatcgttgt

SEQ ID NO: 1038 - DNA, 498 bp, Ctenocephalides felis
  misc_feature (352)..(352): n = unknown
  misc_feature (386)..(386): n = unknown
  misc_feature (489)..(489): n = unknown
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgnatggataaaagataaatacaattttataagctgnttggataaattaattttgaataaatccataatcatagaatatgttaagtagcaaattaaaatatggccacaaaccacaaaatgtatacgaaatataacttatntgatttttg

SEQ ID NO: 1039 - DNA, 328 bp, Ctenocephalides felis
taaaatgttaaatatttataatatatttctgataaataagggtcattaaacatcatttgcatgtttttgaaaaaacaccacaacattgtttatagtaagctttgcctttgttactttagttttcaaaatttgttcaaggccctcttctccctttccttcgtaagcttttttaagtatctcataagtcaatcctttttttgacattttgcgaagtgtttcaatggttacgactgatttaagaggtgccaataatattagctcatcagccattttttgcatttccaaaatatcatcgataattctgagtttgtttgaaagttgcttcagt

SEQ ID NO: 1040 - DNA, 412 bp, Ctenocephalides felis
  misc_feature (4)..(4): n = unknown
  misc_feature (20)..(20): n = unknown
  misc_feature (38)..(38): n = unknown
  misc_feature (79)..(79): n = unknown
ccgnttttatattatattgnttatacagaaagcactgntgtatgaaaagtatctgaaatcaacacatctcatgtaaggntactttattgtaaaagttattttatatgtaatttttaataacattaaaattatttagttctttctgttagatgaattgtgtgttagatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattgttaaaaatatttgtggctagattttcctattgctaattgtgtg

SEQ ID NO: 1041 - DNA, 363 bp, Ctenocephalides felis
  misc_feature (20)..(20): n = unknown
  misc_feature (32)..(32): n = unknown
  misc_feature (84)..(84): n = unknown
  misc_feature (342)..(342): n = unknown
ggaagctttttcaggaaagntactagagaggngtcatttccaccagtgggttcaagaaataatcgtacaatcagctgtgtccgngccctagaccaatatgtaaatggccaaggaggctatgccactcttgtcaatggtggagttggctggaaaaatgtaactttactcttatcttctcagactggcaaaggatttaacttcttagttgaaatttggggatattagattagagatttaataaaaatgttattatagaaaatatattaaatatacaatagtattttaaatatggcacacatctatctatgcatccataaataaaggttatctactgcataaaanaaaaaaaaaaaaaaaaaaaaa

SEQ ID NO: 1042 - DNA, 484 bp, Ctenocephalides felis
  misc_feature (234)..(234): n = unknown
  misc_feature (265)..(265): n = unknown
  misc_feature (304)..(304): n = unknown
  misc_feature (322)..(322): n = unknown
  misc_feature (331)..(331): n = unknown
  misc_feature (384)..(384): n = unknown
  misc_feature (387)..(387): n = unknown
  misc_feature (423)..(423): n = unknown
acgtcaacgaatggtttgcccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgcccccggcgaagaatgcaaaagtgagattgctaagtaaggnttaaaccaggaaaacaatcttgaatagactnattaggattcaaattatcataaagtagtcaattaatatnataaatcacaaatgatcngtgcaattnaatataaaaaatatgtataaaaattaaaatgtataaaattgtgttttatgtanggngcacaaacaaaatgcattaactatagtaatttctgnttatttaaaatatataaatatagaagctttatgaaattcatgtgtctttttaataaaaata

SEQ ID NO: 1043 - DNA, 257 bp, Ctenocephalides felis
  misc_feature (23)..(23): n = unknown
  misc_feature (36)..(36): n = unknown
  misc_feature (89)..(89): n = unknown
  misc_feature (93)..(93): n = unknown
  misc_feature (110)..(110): n = unknown
  misc_feature (113)..(113): n = unknown
  misc_feature (120)..(120): n = unknown
  misc_feature (126)..(126): n = unknown
  misc_feature (144)..(144): n = unknown
  misc_feature (173)..(173): n = unknown
  misc_feature (185)..(185): n = unknown
ttttttttttttttttttttttncgctttccgcatntccacaagccaaaaccaagtctgtgccagcattaaaaacccaatccttctcgngttntttcagcgctatttcanatnttaactntgtttntaaccgtctcaatacctnttcaggatcgcgtatggcctcatttttgngtgtcaacctgnggtcaacatcgccaatccatgttaccaatcgatccttacgattagcaaacatttcaccgagtcccaaacgtt

SEQ ID NO: 1044 - DNA, 498 bp, Ctenocephalides felis
aacatttcagactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggtacaatccagggagaccatcagacttgaagattttggtcaagcagttgcccaatccagagaattcacgttgaccagcgcctttacctacatcagcggccaatctggtacgggcgaaatcaagtgggtagacgaagcacaatgatgtggctccagcagcaccaccagatgccaagtttcctgcgaagtaacgccagaattgggtcttcttgtcaactccacccaagaaaacttgcttgtacttgtctttgaatgcgaagttcaaagcctga

SEQ ID NO: 1045 - DNA, 220 bp, Ctenocephalides felis
  misc_feature (43)..(43): n = unknown
tatataatctgattctcgatttgcatcttcataactgattctnagatatccattaccggaatgttcatcattacgtctgagttgtccactaaattcaacttttttccattttcttccatgacatgtctgaattttattttaccatcaactaaagattccatgtgagctcttgcgcaagttccatctcgttcaaaatgattttggtatctatattgttcgt

SEQ ID NO: 1046 - DNA, 498 bp, Ctenocephalides felis
  misc_feature (404)..(404): n = unknown
ctagtgagtgtgttatatgaaattgctattgcatattacatacaagcttaataaaggttatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgttttaagtataaatcttattagggcacaatatgaaaataaaaataagaactttatncaaaagctttttttatacaatatgcttcttgcgctattaagttaagaaattttatttatgcttgtaaaaaaacaataaatgctttatttttttt

SEQ ID NO: 1047 - DNA, 486 bp, Ctenocephalides felis
  misc_feature (45)..(45): n = unknown
  misc_feature (51)..(51): n = unknown
  misc_feature (209)..(209): n = unknown
  misc_feature (336)..(336): n = unknown
  misc_feature (484)..(484): n = unknown
tatatgaaattgctattgcatattacatacaagcttaataaaggntatggngatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgnagtagttgttatagacaatttacttaataattatgagttgcatcattatgcaatgatttatcactattatttattcaacattttatttaactgcttgcaacttttaataaaacgcattttttattgntttaagtataaatcttattagggcacaatatgaaaataaaaataagaactttatacaaaagctttttttatacaatatgcttcttgcgctattaagttaagaaattttatttatgcttgtaaaaaaacaataaatgctttatttattnaa

SEQ ID NO: 1048 - DNA, 465 bp, Ctenocephalides felis
cactcgtgttcttttcccatcttcattttgactgcccaacataagtataatgtctttatcccctagattgctgcttgaaacaacaactgtatgcacatgacggctatgaaaccattctgtgcatttccatgcatcgtcaatgttatgaattttgcaaccagtgagcaactccacctcaaattgatttggagtaacaatatcagccaatggaataattaattctctataaattggtaataatgattctggaacatacatttttccattatcacctaacactggatcgcaaacgtatgtcaattttggatttttttctctcaattccttaacgacgtttgcaattgttttaagaaaatctggattagctacataacccgttaataaatgactgtagacattgataccattcaatgctaacccttctgccagctctcctaattccttgtcgttagaacttgccctcgt

SEQ ID NO: 1049 - DNA, 131 bp, Ctenocephalides felis
  misc_feature (104)..(104): n = unknown
attgtctttggagtctcaagaactaattccagttgaaacaaattccagcagcgttcgtatttggcagcaaccattcatttgtccaagagttgggctattttttnatccattggatcctacatgcaaaaggt

SEQ ID NO: 1050 - DNA, 358 bp, Ctenocephalides felis
  misc_feature (26)..(26): n = unknown
  misc_feature (47)..(47): n = unknown
  misc_feature (58)..(58): n = unknown
  misc_feature (230)..(230): n = unknown
tttttttttttttattggtttttagntcacttgctggtttattagantatgtatttgntcatctataaaactaatagttaagaaaaattatttcaagttacaatttcacacgatgcaattttccacaacatcattaatttcttccaatctggattcccatttattcaaattgtctgaagaacattttcccaaatctaaacgaagttccacgacattcctgagggcttctnctactttaatgccaacatcagttgaaactctggctgctgctagttgtatatttaatgcaaccttttgcatgcatttggccgattcttttcgttccctgaaactcattcttgcaggcaatttatcaagt

SEQ ID NO: 1051 - DNA, 259 bp, Ctenocephalides felis
  misc_feature (26)..(26): n = unknown
  misc_feature (30)..(30): n = unknown
  misc_feature (49)..(49): n = unknown
gcccatttttaatgaaatctatcctncggntctaacgtgaatatcactnctgtagcagttcctatggataatagaagtcccattagggacatagagccacgaatttccatttaaatatatgtatttatctttaaataaaataaaacaataatttggtcaattttaattctcatagcatcagcagtttcataactgtaattaaatcatcaataatggctggtgacaacaaatgggatatttacagtttttacaccattgt

SEQ ID NO: 1052 - DNA, 408 bp, Ctenocephalides felis
  misc_feature (12)..(12): n = unknown
  misc_feature (101)..(101): n = unknown
  misc_feature (123)..(123): n = unknown
  misc_feature (144)..(144): n = unknown
  misc_feature (181)..(181): n = unknown
  misc_feature (235)..(236): n = unknown
  misc_feature (307)..(307): n = unknown
  misc_feature (325)..(325): n = unknown
  misc_feature (342)..(342): n = unknown
  misc_feature (379)..(380): n = unknown
  misc_feature (396)..(396): n = unknown
aaatacaggggntcacagaagcattcagacaacgagattcccaacaaacaggaaccataacaatagctttcgaagattttctcaatggtgctttaaggtgntctatttaaaaaaaatcattgntaacaataaagatttaaaaantttcataagtattaaataaatttcacacacaactttntgtattaaaaggggttttattatcaattagttaataaaataactctaaaattgnnaatgaaatttttattgtatatataaaattgaaatacctacattttgtatgcagatgttataactgattgtnagtgaaccaattattgtnaggaatatgggacgccntattttcactcatttttttacactttaactataatgnnacagaaattatagtgntattccatttgt

SEQ ID NO: 1053 - DNA, 482 bp, Ctenocephalides felis
  misc_feature (156)..(156): n = unknown
  misc_feature (194)..(194): n = unknown
  misc_feature (278)..(278): n = unknown
  misc_feature (355)..(355): n = unknown
  misc_feature (442)..(442): n = unknown
  misc_feature (444)..(444): n = unknown
tttttaatttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgctactttatgataatttgnatcctaaataggctattcaagattgttttcctggtttaagccttacttagcaatctcacttttgcattcttcgccgggtggcgngggtatgcatcgcaactccgttttatcaaagtgcaagccatttggacaatcataatgttttatttgccatttgttgntaaccaagaaacattgataatattttttacaatctcttcgatcggaaaaaacgttttcacttttgcatgcagttctgcacgagaaanantttgggtcaaaccattcgttgcgcgcttcacattttaa

SEQ ID NO: 1054 - DNA, 147 bp, Ctenocephalides felis
taaagcctcacacaaacaatgcgttctaagactagccaaaccagaggtatataacatacctagaacaaaggtgttaatgaagtggcctcaacataatcgattagtgcactcttctgcagctttttatgcatcaaaagtagttaatgt

SEQ ID NO: 1055 - DNA, 386 bp, Ctenocephalides felis
  misc_feature (213)..(213): n = unknown
  misc_feature (363)..(363): n = unknown
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgaggaattgntttatatggaccataaccatatttccgtcgtgtgttgtgaaatgcaattatactttgagaaagtattatcaattacaaagaaaattcagaagttgctactgaatcattttctaaaacatcgacatgaaaattaataactctttattgttnttagattcgatgtaagatatatg

SEQ ID NO: 1056 - DNA, 480 bp, Ctenocephalides felis
  misc_feature (198)..(198): n = unknown
  misc_feature (263)..(263): n = unknown
  misc_feature (319)..(319): n = unknown
  misc_feature (332)..(332): n = unknown
  misc_feature (348)..(348): n = unknown
ttttttttacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgnggatttattatattaattgactactttatgataatttgaatcctaattagtctattcaagattgntttcctggtttaagccttacttagcaatctcacttttgcattcttcgccggggggngtgggtatgcatngcaactccgttttatnaaagtgcaagccatttggacaatcataatgttttatttgccatttgttgttaaccaagaaacattgataatattttttacaatctcttcgatcggaaaaaacgttttcacttttgcatgcagttctgcacga

SEQ ID NO: 1057 - DNA, 377 bp, Ctenocephalides felis
  misc_feature (14)..(14): n = unknown
  misc_feature (26)..(26): n = unknown
  misc_feature (60)..(60): n = unknown
  misc_feature (62)..(62): n = unknown
  misc_feature (77)..(77): n = unknown
  misc_feature (136)..(136): n = unknown
  misc_feature (138)..(138): n = unknown
  misc_feature (154)..(154): n = unknown
  misc_feature (172)..(179): n = unknown
  misc_feature (192)..(192): n = unknown
  misc_feature (194)..(194): n = unknown
  misc_feature (214)..(214): n = unknown
  misc_feature (245)..(245): n = unknown
  misc_feature (264)..(264): n = unknown
  misc_feature (283)..(283): n = unknown
  misc_feature (308)..(308): n = unknown
  misc_feature (353)..(353): n = unknown
cctacacaactcanggcaatggcagnatgtatatctttaatgatgggtcgattaggaagngntgttggaagcaatgntgtaggaataattctagattataattgcgatttaacatttttaatatcaggaacatctntnatagcatgtggagggnttgcattctttattcccncattttnataagcaagtggntngaagaacgagcatttgcttnatatggccataaccatatttcgcgtgtgtgngaaatgcaattatctttgngaaagtattatcaattacnaagaaaattcagaaggtgctactgnatcattttctaaaacatcgcatgaaaattaataactctttattgntattagattcgatgtaagaatatg

SEQ ID NO: 1058 - DNA, 283 bp, Ctenocephalides felis
catcactgagaagaactcttcggctacggaatatcttcattggaggcgcgttgttggtgcacgcagcattaacaaggttcttgcaattcagcataatgaccagaagaaaaatacaggtactgcttttcattttgattcagtaatagattacttcttgagatagataataatactgtggagaagtaaccttcacatgaaataggcttgggtcttataattactggctttgttctggatattagaaatctgatcacaaaattttattaagttattattatgttaa

SEQ ID NO: 1059 - DNA, 381 bp, Ctenocephalides felis
  misc_feature (24)..(24): n = unknown
  misc_feature (51)..(51): n = unknown
  misc_feature (216)..(216): n = unknown
  misc_feature (222)..(222): n = unknown
  misc_feature (226)..(226): n = unknown
  misc_feature (236)..(236): n = unknown
  misc_feature (239)..(239): n = unknown
  misc_feature (293)..(293): n = unknown
  misc_feature (318)..(318): n = unknown
ttttttttttttttttttttttgnatgctggatataacctttatttatggntgcatagatagatgtgtgccaaatttaaaaaactattggatatttaattttttttctatattcacattttcattatatttctaatctaatatccccaaatttcaactaagaagttaaatcctttgccagtctgagaagaaaggaggaaaggtacattttttcagncaactncccattgcaagagnggnatagcctccttggccatttacatattggtccagggcacgaacacagctaattgngcgattatttctcgatcccactggnggaaatgacacctctctagtagctttcctgaaaaagtttccactcttggattggacttgacgg

SEQ ID NO: 1060 - DNA, 413 bp, Ctenocephalides felis
  misc_feature (39)..(39): n = unknown
  misc_feature (78)..(78): n = unknown
  misc_feature (96)..(96): n = unknown
  misc_feature (172)..(172): n = unknown
  misc_feature (177)..(177): n = unknown
  misc_feature (182)..(182): n = unknown
  misc_feature (202)..(203): n = unknown
  misc_feature (217)..(217): n = unknown
  misc_feature (231)..(231): n = unknown
  misc_feature (253)..(253): n = unknown
  misc_feature (300)..(300): n = unknown
  misc_feature (302)..(302): n = unknown
  misc_feature (360)..(360): n = unknown
  misc_feature (377)..(377): n = unknown
  misc_feature (379)..(379): n = unknown
  misc_feature (396)..(396): n = unknown
  misc_feature (398)..(398): n = unknown
  misc_feature (401)..(401): n = unknown
tatttttattaaaaagatacatggggatttcataaaggnttctatatttatatattttaaataatcaagaaattcctntagttaatgacattttgnttgggctccctacataaaatacaattttatacattttaatttttatacatatttttttatatttaattgcacagancattnggggnttttattatattaattgacnnctttatgataattngaatcctaattagnctattcaagattgtttcctggnttaagccttacttagcaatctcacttttgcattcttcgccggggggngngggtatgcatcgcaactccgttttatcaaagtgcaagccatttggacaatcataatgntttatttgccatttggngntaaccaagaaacattgntnatnttttttacaatc

SEQ ID NO: 1061 - DNA, 495 bp, Ctenocephalides felis
  misc_feature (133)..(133): n = unknown
  misc_feature (209)..(209): n = unknown
  misc_feature (260)..(260): n = unknown
  misc_feature (285)..(285): n = unknown
  misc_feature (329)..(329): n = unknown
  misc_feature (334)..(334): n = unknown
  misc_feature (366)..(366): n = unknown
  misc_feature (408)..(408): n = unknown
  misc_feature (411)..(411): n = unknown
  misc_feature (449)..(449): n = unknown
  misc_feature (467)..(467): n = unknown
  misc_feature (481)..(481): n = unknown
  misc_feature (487)..(487): n = unknown
ttttttttttttttttttttaacggcccaaacgatttatttttattaaaaagatacatgtaatttcataaagcttctatatttatatattttaaataatcagaaattactatagttaatgacattttgtttgngctccctacataaaatacaattttatacattttaatttttatacatattttttatatttaattgcacagatcattnggggatttattatattaattgactactttatgataatttgaatcctaattngtctattcaagattgttttcctggnttaagccttacttagcaatctcacttttgcattcttcgccgggnggcgngggtatgcatcgcaactccgttttatcaaagngcaagccatttggacaatcataatggtttatttgccatttgntgntaaccaagaaacattgataatattttttcaatctcttngacgggaaaaacggtttnacttttgcatgcantcttcncagaaaaa

SEQ ID NO: 1062 - DNA, 500 bp, Ctenocephalides felis
  misc_feature (63)..(63): n = unknown
  misc_feature (271)..(271): n = unknown
  misc_feature (323)..(323): n = unknown
  misc_feature (405)..(405): n = unknown
  misc_feature (424)..(424): n = unknown
  misc_feature (444)..(444): n = unknown
  misc_feature (454)..(454): n = unknown
  misc_feature (471)..(471): n = unknown
  misc_feature (474)..(474): n = unknown
  misc_feature (491)..(491): n = unknown
ctatcttttgctccaatgctcaaaggcgataatggacccacagcctggcgtccaaaatgcttnctcgtccgcaacgacatagtcgttttgcaagatttatccatgtataattttcgccattcgtacccaaaattctctttggatcttgatcatgttaaaggtgctttaacggcattggctcgtatgcatgcaaggtgcattatctacgagaagaaaaaaaattgttgcatggggagaggttacaaagatcttatgttcgagactatggccnataataatcaatggtggaggactggagaggatactgctttagcaattgctgnggaatctgagaaattcggtaaatataccgaatccattccatggtacaggagaaggtaattgatttcctgagattggcatggnctatggtaaaccatccccntttataaaatgtggttgccncccgatcccnccacaccaattgtggtnaanataattaactggctacntgacaaagc

SEQ ID NO: 1063 - DNA, 422 bp, Ctenocephalides felis
  misc_feature (193)..(193): n = unknown
  misc_feature (270)..(270): n = unknown
  misc_feature (317)..(317): n = unknown
  misc_feature (377)..(377): n = unknown
  misc_feature (395)..(395): n = unknown
cacacagtcagtgatagagttaccgcgttcgttccgcacttaaccttacgaatacttagattttctccaagaaaatcttttatctaagaagaaaccaaattcaagttgatgcattattctccggaattgttagagaatctgaacaacggttcgttgttcttcagctacgaatacaaccggcactgtaaagggnctttgaagaaactggctcgaaagctgctcccgttaggacggccgttctgaagattgggaacaagtaaagattaccangaaaggggaacgatgatggccaggaacagaattttaccgcatcttanccaacgtcttcggacatcatgtcaacatcattcatcacaaatatcatcgcagtttaggtngtaatagttaacactttnggataggaaataagcttaaagaaggga

SEQ ID NO: 1064 - DNA, 425 bp, Ctenocephalides felis
cgatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatctttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 1065 - DNA, 486 bp, Ctenocephalides felis
  misc_feature (38)..(38): n = unknown
  misc_feature (65)..(65): n = unknown
gcattccagacaagtttccttggcgcatttggaggggncagggcatcctctcttcactttatctncgtcaatgggtaagtagcatttgcccatacacttggtcttcgtctcgactttttcaggatcggccaggcaattttcatcattttcatcgcaggaaacacattcgtgttttttagcatcaccattgcattcattttggtcacaagttgggcaacggtctggttttttctcgcacatttttttcagattttggttcttgaacagggtgctggtgcagcctaatttgatggcatcaccttgtgcattcagaatactcaaacaagtatctttaggattgagacaaacttctttggcatcatctttagcattgcaaaccctgcgatttcttgggaaaacatcgatattacaaagggtacctttgcctcctggcattttaaatcatacaggcatcaatcgggttcatacaccccctgttttgttcat

SEQ ID NO: 1066 - DNA, 291 bp, Ctenocephalides felis
ggaagcatgtgtggaagttgaagctttgaaggatggtattgatttctgcaccaaaattacaagagcaagatttgaagaattatgctccgatttattccggtctactttacgcccagttgaacaagcattaagagatgcaaagttagacaaaggagccatacatgatgttgttttggtgggaggttccacaaagaatacctaaaattcgatctctgctcaagaattctttgcaggaaagaccttaaattcttccataaatccagatgaagctgtggcttatggtgctgcagt

SEQ ID NO: 1067 - DNA, 278 bp, Ctenocephalides felis
  misc_feature (199)..(199): n = unknown
  misc_feature (233)..(233): n = unknown
aatttaggccgccatgaaaaatttgttctattccaaattttagatcatttttttttagaaaatctctaataattaactaccaatataaattatatatagcatgaaaaataattcaattacataaaaatttagcaaaaatgtttataaaatctttgcttcattgattattgatcttttacatttaaaaaaaaaatcagtntttattttgaccggtgagacaaaataaacatcgngagtgaattattttagaagctataatatatattaactaaatatgt

SEQ ID NO: 1068 - DNA, 430 bp, Ctenocephalides felis
  misc_feature (86)..(86): n = unknown
  misc_feature (211)..(211): n = unknown
  misc_feature (296)..(296): n = unknown
  misc_feature (299)..(299): n = unknown
  misc_feature (366)..(366): n = unknown
  misc_feature (382)..(383): n = unknown
  misc_feature (387)..(387): n = unknown
  misc_feature (405)..(405): n = unknown
  misc_feature (413)..(413): n = unknown
  misc_feature (416)..(416): n = unknown
  misc_feature (428)..(428): n = unknown
cgtattcaatggtatgaattgcttggtgaatgaaaatttcactcatgggttcttcttcgtgttctccatgagctgcttttggcggngcctttggtgcctctggcataccgttttcttggctggagacaacgtctgaagtcatttccattccttggtttaaatcaccatttgatttaacagaatgaggagcctcatctttatttttcttggntggcatcaaatataatgggttgcctaagagcatgagcggaatacagcagagcccaattaacacaaatattttttgaatttgctgntgnccttcaaacataaattcatcgcattgttctgctggagaaccttgcttggataacaacatgttaatgnacaagaatcaaaactnntggngcgcagcaggggtcaaanctggtggntgnttatttggaganga

SEQ ID NO: 1069 - DNA, 378 bp, Ctenocephalides felis
  misc_feature (18)..(18): n = unknown
  misc_feature (29)..(29): n = unknown
  misc_feature (46)..(46): n = unknown
  misc_feature (267)..(267): n = unknown
ctgcagtcatcagagggnaactttttcangaaagctctagagaggngtcatttccccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatngaaaaaaaattaaatatacaatagtattttaaatttggcacacatctatctatgcatccataaataaaggttatatacagcattcaaaaaaaaaaaaaaaaaaaaaaaaaa

SEQ ID NO: 1070 - DNA, 229 bp, Ctenocephalides felis; identical to SEQ ID NO: 490

SEQ ID NO: 1071 - DNA, 387 bp, Ctenocephalides felis
  misc_feature (347)..(347): n = unknown
tgtcaagtccaatccaagagtggaaactttttcaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaagggatttaacttcttagttgaaatttggggatattagattagaaatataatgaaaatgtgaatatagaaaaaaaattaaatatacaatagttttttaaatttggcacacatctatctatgcatccataaataaaggntatatacagcattcaaaaaaaaaaaaaaaaaaaaaaaaaa

SEQ ID NO: 1072 - DNA, 205 bp, Ctenocephalides felis
  misc_feature (14)..(14): n = unknown
  misc_feature (19)..(19): n = unknown
  misc_feature (35)..(35): n = unknown
  misc_feature (133)..(133): n = unknown
tttttttttttttnttttntaatacatttacattngagatacatttcaaatttacaattaatttacatgattcataaattgtgatataaaccataatcaaccaaagaacacggtttacagaaaattggaatgnataatttgtatcaatgctttatatatttgactcctgacaatcttaattatacacctacacataattttctat

SEQ ID NO: 1073 - DNA, 150 bp, Ctenocephalides felis
  misc_feature (2)..(2): n = unknown
  misc_feature (101)..(101): n = unknown
cncgctaaaggggaattcacttaaatctttaagcgagtgcttgcaaactatcgatactatcgatggtttcagacttttttctttcataaatacttttttgngatatgaacatacttcgcaaaaattaaatttgacaaaaaaaatttaagt

SEQ ID NO: 1074 - DNA, 222 bp, Ctenocephalides felis
tttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaaaatgctatacagttacatgtcctgcacagcctaaggtgcttccgt

SEQ ID NO: 1075 - DNA, 467 bp, Ctenocephalides felis
  misc_feature (28)..(28): n = unknown
  misc_feature (187)..(187): n = unknown
  misc_feature (209)..(209): n = unknown
  misc_feature (215)..(215): n = unknown
  misc_feature (263)..(263): n = unknown
  misc_feature (285)..(285): n = unknown
  misc_feature (383)..(383): n = unknown
tttttttttttttttttttatttccggnccatacaactctaagctttccaacatttgtattttattcaaataaatataaataaaaatcataattcgacaattttactcgtatttatcttaaacatatttacagtatttcctcaaaaactgttaaatacaataagttaacttaaatacatggatgttntgagaatgtggatgagctcaanattgtngaactgagtttgatctacacaatttttgcctaaaaggttcgactactnagaaagcagccacccgtgattncataccgcctcacatttgacaataaaatatatgtataatgttaaataggattttaatggaaaaaagccaatttaatactttagcattatgaatatgtntttccaaattattctataacgaatttaacctaaaatacaagaaatacatattcataaatatacatatattttaatacaaaaagg

SEQ ID NO: 1076 - DNA, 500 bp, Ctenocephalides felis
  misc_feature (409)..(409): n = unknown
ttttttttttttttttttttttttcgttaaatcaaatcaatatatttcttcatgtttgtcaagcatggacatttgaaatttggtttatttttaaccaaacaataagtcaattacaagagaaataaaaatttcaaagaaaaccaagacacaatactgataattgtatgtttagtagattcatataaaacttccttaactgaaatgctgatataaactacttttaacagcaactccatgagcatcaatgatagcagtcttaaaattatgttttcatacatacatcattgattttttagcatagcagttagatgacaattacatttatttaaagttacgaatgttgtcctttcacagagtattaatttaatgtattttgctaagaaatcaaaaatgaatgtaattcgggggnattctcacttttcattgtagagaatattgcattaggtttcgatattatcacaattcatctgtttagacttcagccattcgcaaattcattt

SEQ ID NO: 1077 - DNA, 205 bp, Ctenocephalides felis
ctgctaattatatacaaattatcaaaggcaatgttaatgctaatacaactgataaagttgagacaaaataaaggaagattcagataaaaatgtaaatattaatattaggcatttataacaaatcatgtgcttttccttgctcactaagatcttgctattatgttatggttgatactagacaactgtatattaagtaattataagt

SEQ ID NO: 1078 - DNA, 304 bp, Ctenocephalides felis
  misc_feature (237)..(237): n = unknown
ccgggcaggtactacttcatgtattaagcattttgtatgaatattatgtagtcgatgtgtctctaatatattactgttgagcaacatatttttatagataagagtagatgtaataattcattttaagaattgagttactagaattattctattatgctgtattatatgttaatataactatattaaaagaaaaattattaatattaatgcatcttttaataaactgaaaagaacagngaaaaaaaaaaaaaaaaaaaaaaaaaaaaaaaaaaaaaaaaaaaaaaaaaaaaaaaaaaaaaaaaaa

SEQ ID NO: 1079 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgcccccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgttctttttaataaa

SEQ ID NO: 1080 - DNA, 498 bp, Ctenocephalides felis
atattttgtatagtttcttttgttgaatacttcatcaatatattaatataatttaggtttcctctcgcaagttcctgtgtcgcagctttgagtagcttggttaaatactgttccaatcggacattgatcaggaactggctctcctttaggacgtaaacacgtgaagaacttccggcatgttgcgtcgttcttgaaagcaaattttccacgtgctcggcattgcccgacacaggtttcgctccttggggaaaactcggcgggttcttcgcattgcaatacggttcctcttccggccatacatacgacgtacaatgatttatcaccaatgtacggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttat

SEQ ID NO: 1081 - DNA, 495 bp, Ctenocephalides felis
  misc_feature (64)..(64): n = unknown
  misc_feature (176)..(176): n = unknown
  misc_feature (402)..(402): n = unknown
  misc_feature (404)..(404): n = unknown
tttttttttttttttttttttttttatttcttacttttaattttattttcttcatttttatatnaactctatatctttatctatctatctattagttcaaccaataaaattaagcgtaaaatgaataattttgattagaacaaatatattcatggatttaaaaaaatctaaattgnaaaattcttaaatgccttatcatatttgcgagcctgtgttcaaccataatatttttttatataacacataaagtaaaacaaagtcatattttgtatagtttcttttggtgaatacttcatcaatatattaatataatttaggtttcctctcgcaagttcctgtgttgcagctttgagtagcttggttaaatactggtccaatcggacattgatcaggaactggctntnctttaggacgtaaacacgtgaagaacttccggcatgttgcgtcgttcttgaaagcaaattttcacgtgctcggcattgccgacacaggttt

SEQ ID NO: 1082 - DNA, 498 bp, Ctenocephalides felis
aatcaattatttattgactatataaataatatacagatgttagttaaaattgcatacaacatgaacatttcattttcttctatttttgacaaagtttattttaaacaggtgttgaaataatttcagtgtacagctttactttactggcaacactcatatcaacataacgatctccaattgatacgaccattccacccaagattgagggattaactttaagggttagtaataagttttctttgggttttaagaatcctcttaaagtgctttcaagttgtttttgttgattctcatctaaaggtttagctgttgtaacttcacatggaacctctccacgatgagcagacatcataactttataagcgttgataacaccttccagtttatttaaacgtccattctcagcaagtaactccagcaagttggatgtagctggagccatttgcagcttgctgctggcttccttcaatgcatttgatttaatggagcgcttgaaag

SEQ ID NO: 1083 - DNA, 394 bp, Ctenocephalides felis
cgtcaagtccaatccaagagtggaaactttttcaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatacagcattcattaaaaaaaaaaaaaaaaaaaaaaaaaaaaaaa

SEQ ID NO: 1084 - DNA, 438 bp, Ctenocephalides felis
tcgtggggtagttcttggaaaatttcttgacttccctgtgatacatttcctgagcccgtgaacacgaacgtcaatggacctacagattttggcatcatacctaaagcgatttcatatccagcatcccttatggattgtctggccatggaggaatttctgtaattgtgagccaatccaatatgcatgaaaggtgtatgatgacccaaagctaaaagacgtaaacctaatccgtgcaaaatattgatcataccggcaacaccagcatattttccaaatgctactactctttggcccttttcgtccatcaacttttcataatcgataagacgaatattcttttccataattgcatcaagtaaaggcatattagattcttgggctttgataacatgtgaaaacatgcagtaggttttattgggaattaattgttctacaggt

SEQ ID NO: 1085 - DNA, 498 bp, Ctenocephalides felis
  misc_feature (36)..(36): n = unknown
  misc_feature (475)..(475): n = unknown
  misc_feature (489)..(489): n = unknown
gaggagactttgtttaccgtaatggacaaccattcnaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggccacaaaccacaaaatgtatacnaaatattacttatntgattttta

SEQ ID NO: 1086 - DNA, 387 bp, Ctenocephalides felis
cttttatggtgtctttgagaaccaaccaaggacacttctgtggtggttccatcatcagcaatcgttggattcttactgctgctacttgcgtgttaaataaatatccaaatgatattcttctcgtcgttggaaccaacactttgaatgctggcggagtaggatacaaagttgcccaaataatcgttcataaccaatttaaccagaacacataccacaataacatcgctttgctaaaaactacatcaaatattgtatacacaaactatgtcaaaccagttggtctggcaagctatgatacaccaattggagcagtatccactctggctggatggggctacttatctaatggtggccaaattcccaactacttgcaaatcgttgacacgt

SEQ ID NO: 1087 - DNA, 387 bp, Ctenocephalides felis; identical to SEQ ID NO: 1086

SEQ ID NO: 1088 - DNA, 498 bp, Ctenocephalides felis
  misc_feature (401)..(401): n = unknown
  misc_feature (442)..(442): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtnaggagcacaaacaaaatgtcattaactatagtaatttctgnttatttaaaatatataaatatagaagctttatgaaatcaaaaaaaaaaaaaaaaaa

SEQ ID NO: 1089 - DNA, 500 bp, Ctenocephalides felis
  misc_feature (276)..(276): n = unknown
  misc_feature (484)..(484): n = unknown
ttttttttttttttttttttttttttttttatttccggtccatacaactctaagctttccaacatttgtattttattcaaataaatataaataaaaatcataattcgacaattttactcgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcanaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatacatattcataaatatacaatattttaatacaaaaaggtacttgngcaaaaatgaaattca

SEQ ID NO: 1090 - DNA, 500 bp, Ctenocephalides felis
  misc_feature (146)..(146): n = unknown
  misc_feature (148)..(148): n = unknown
  misc_feature (229)..(229): n = unknown
  misc_feature (291)..(291): n = unknown
  misc_feature (315)..(315): n = unknown
  misc_feature (330)..(330): n = unknown
  misc_feature (344)..(344): n = unknown
  misc_feature (360)..(360): n = unknown
  misc_feature (381)..(381): n = unknown
ctttttttttttttttttttttttttttacaaaggaacggcccaaacgatttatttttattaaaaagatacatgtaatttcataaagcttctatatttatatattttaaataatcagaaattactatagttaatgacattttgttngngctccttacataaaatacaattttatacattttaatttttatacatattttttatatttaattgcacagatcatttgtgtntttattatattaattgactactttatgataatttgaatcctaattagtctattcaagattgntttcctggtttaagccttacttancaatctcacttttgnattcttcgccgggnggggtgggtatgcatngcaactccgttttatcaaagngcaagccatttggacaatcataatgttttatttgccatttgttggtaaccaagaaacattgataatattttttacaatctcttcgatcggaaaaaacgtttttacttttgcatgcagtc

SEQ ID NO: 1091 - DNA, 379 bp, Ctenocephalides felis
  misc_feature (354)..(354): n = unknown
  misc_feature (356)..(356): n = unknown
aaacttgtataagatatctgaaacatttaaaaacaatatgtgaaatatttaatacatcataattttttttattaaattaaaagaaaatggcgatctactcaacttatctgaattagtttaggtataagtaaattagaactaattctatttgtttactacttttgttactcgtatttaattttgatttaaattatgtatgttattttagaaagcactgataagtataaggaattgttgaactgtattttataagactgctaggcaaatcacgtttatttataaaaaaatgtactgtaaatgtacctgcatgtaaactgaactgtaataattattaaataaagtattttaaacccnanaaaaaaaaaaaaaaaaaaaaaaa

SEQ ID NO: 1092 - DNA, 326 bp, Ctenocephalides felis
  misc_feature (207)..(207): n = unknown
  misc_feature (305)..(305): n = unknown
  misc_feature (324)..(324): n = unknown
attgttctcttacaaatctaaaaattagaactaatctatgatataaataaaaaataggcagcatacttatacacaatgtatctaatacaatatgtattacttcacgattgttgtcatataaacttcaatacccagaattttttttgcagttgttcaaaattacaaattgtctgcacaatccatagatcggagtgttttcggaatggntcttttccacttagatttctttacgtaaacacaacacaaagcgtgtggagcaaaagttttcgataatactgcattatattgaatatatctgttaatgntccaaatcatgtaggttgnag

SEQ ID NO: 1093 - DNA, 380 bp, Ctenocephalides felis
atggattcatgtgcctttacctttagtatttgccgaatatttttcacaggagagatttccttcagcatacggactgttcatgttcttgcaaggaataatgacattggctttgggtccaattgttggatttattcgagatgcaacacacagctacataatatgtttccatgccttgactgtgtgtttactcatttgctgtataccatggcttgccgagatggcgtggttaaaaatgaaaaataagaaataaatttaagaattaagttaatattaatggaaaaattatatatagtttatgtgaattttatcacacgtgttatatatctttataaaagtaatttataaaggattgtcacagaaaatataaatgacaaaaaaaa

SEQ ID NO: 1094 - DNA, 380 bp, Ctenocephalides felis
  misc_feature (63)..(63): n = unknown
  misc_feature (234)..(234): n = unknown
  misc_feature (316)..(316): n = unknown
  misc_feature (332)..(332): n = unknown
ttttttttttttttttttggaatgctgtatataacctttatttatggatgcatagatagatgngtgccaaatttaaaatactattgtatatttaatttttttctatattcacattttcattatatttctaatctaatatccccaaatttcaactaagaagttaaatcctttgccagtctgagaagataggagtaaagttacatttttccagccaactccaccattgacaagagnggcatagcctccttggccatttacatattggtccagggcacgaacacagctaattgtgcgattatttctcgatcccactggnggaaatgacacttctntagtagctttcctgaaaaagtttccactcttggattggacttgacggt

SEQ ID NO: 1095 - DNA, 498 bp, Ctenocephalides felis
  misc_feature (382)..(382): n = unknown
tccatgcacgctattcaaatttcacactgatctattaatacagtcttgaatcacatacagactcctcatatgtataatcacatataatgtttcataagccttaattgaaatggaatttaaattgaaatggtgatccatgatggaagtgatggaacggtgaaccaccgccccctctgtgattatttgcagattctggatctaaaggatcttcaccggtgtcaaactgagctcttttctcaggatcagtaagaacctctttagcagcagcaatatctataaatttattctctgctattttcttttcatcatctttgaaattatcaggatgccatttttgtgctgcttttcgataagctttaatgatctcttgctttgtagctgntctttttacacctagaattttataatagtctcttctctcagcttgcttttgtaacctctgagccttcaaaagcccatctttcgctctctgacatgctcatttatttccaagctgat

SEQ ID NO: 1096 - DNA, 281 bp, Ctenocephalides felis
  misc_feature (29)..(29): n = unknown
  misc_feature (151)..(151): n = unknown
  misc_feature (177)..(177): n = unknown
  misc_feature (212)..(212): n = unknown
tttttgcttagtttcataaagcttctatntttatatattctaaataatcagaaattactatagttaatgacattttgtttgtgctccttacataaaatacaattttatacattttaatttttatacatattttttatatttaattgcacanatcatttgtgtatttattatattaantgactactttatgataatttgaatgctaaattagnctattcaagattgttttcctggtttaagccttacttagcaatctcacttttgcattcttcgccgggtgg

SEQ ID NO: 1097 - DNA, 500 bp, Ctenocephalides felis
  misc_feature (1)..(1): n = unknown
  misc_feature (3)..(3): n = unknown
  misc_feature (77)..(78): n = unknown
  misc_feature (210)..(210): n = unknown
  misc_feature (219)..(220): n = unknown
  misc_feature (365)..(365): n = unknown
  misc_feature (460)..(460): n = unknown
  misc_feature (500)..(500): n = unknown
ncngcctccatttaagtgcttgggattactataaaattgtatataaaaaatgctgatttataatacaaagcaatgcnnacattttcgatttgtcacatatatattaacttttttcaaatacaatttatctatgcatttagtttatccattttctaacttacaaaatataattctaaatagttcaataagtaacagaatctaataataacntaaataatnntatttaacctctggacagtaaacatggtagagattttaaaatgacaaaacacattcttgaaaatgaagttcaaaacaatatctagttttgatcaagagtttctttggttatgactaaagttttcaaacatcaccgtaagaatggnataattgacttgaataatgcttcctatcaatcaatttttatgtaatcataaaagttaaaattaaacaggaatgctggtttaaataactgcccttncacaaaaatttatttcatctcttaattcacatagataagn

SEQ ID NO: 1098 - DNA, 500 bp, Ctenocephalides felis
  misc_feature (7)..(7): n = unknown
  misc_feature (23)..(23): n = unknown
  misc_feature (35)..(35): n = unknown
  misc_feature (45)..(45): n = unknown
  misc_feature (63)..(63): n = unknown
  misc_feature (72)..(72): n = unknown
  misc_feature (340)..(340): n = unknown
  misc_feature (356)..(357): n = unknown
  misc_feature (365)..(365): n = unknown
  misc_feature (471)..(471): n = unknown
ctattancactagggttaattgntaggtagttttngtataactgntattgatattaaatatgnattattttnatatatgtaaacgaattataatttttgctctttgattacttctactctggtgcattaacttttattcaactagattaaatttttggtttacttctatgcctcacatcagtgtccttcatgtgatcaggagtattttttcgatctggacttttgatctgtatcactctcctccatttcagctttgttgcgtttcttttcataaatgagaataatcgcgcataaaattattacttcagcacagatcccaaaaatggccacaaagcagctnatttatcttgaactcnnaccaaggntgtagaataacagtaattccaatgccttgattagtagcaatacatgttattctcctcgatcgctttttcagccaaatcaatttccaaagcagaatttggttattgncatgatctaacaatttgattcgacggtga

SEQ ID NO: 1099 - DNA, 465 bp, Ctenocephalides felis
  misc_feature (48)..(48): n = unknown
  misc_feature (357)..(357): n = unknown
  misc_feature (405)..(405): n = unknown
  misc_feature (408)..(408): n = unknown
  misc_feature (430)..(430): n = unknown
atggacaaattggagttattcgatgtcttatgtagagtattttgaagngggtaaataaataatacatcgtctcgcgagtttgttaaagtttgattaaataacttagtgatcattttcaagttattgaattacaacactttgaaagcattaagtgcctttgttagattttaacaatatcaacataataaataattatattaaaaattatttaattcactcattttaaacaaaataaatttcatatacaatatttaataaatcctgacaaaattgtatttaatttacttgatattttaaataataaatgttttagttagaatattaaggaaacgtatacattaaaataaaatgatatgntcttcacctttatcttttcaataataccgaaattcgaattagtatggnttncgcttaaattaaatatgtttgnctaaactgccaatcaagaaatcattttaaataagg

SEQ ID NO: 1100 - DNA, 500 bp, Ctenocephalides felis
  misc_feature (263)..(263): n = unknown
  misc_feature (307)..(307): n = unknown
  misc_feature (311)..(311): n = unknown
  misc_feature (320)..(320): n = unknown
  misc_feature (355)..(355): n = unknown
  misc_feature (396)..(396): n = unknown
  misc_feature (416)..(416): n = unknown
  misc_feature (418)..(418): n = unknown
  misc_feature (444)..(444): n = unknown
  misc_feature (453)..(453): n = unknown
  misc_feature (457)..(457): n = unknown
  misc_feature (460)..(460): n = unknown
  misc_feature (462)..(462): n = unknown
  misc_feature (465)..(465): n = unknown
  misc_feature (485)..(485): n = unknown
gtctccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaaatgcttctgcaagtcaacacatttcaaacaaattgctgaggataaacgttacaaaggtatnatcgattgctttgtacgtatccctaaggagcagggcgtactttncttntggcgtggnaacttggccaatgtcattcgttatttccaactcangctttgaacttcgcattcaaagacaagtcaagcaagttttnttgggtggaggtgcaagaananccaaatctggggtactttgaagaaanattggcatntggnggngntgntggagcccataatgtgcttngtctaccacttgatt

SEQ ID NO: 1101 - DNA, 306 bp, Ctenocephalides felis
  misc_feature (79)..(79): n = unknown
  misc_feature (272)..(272): n = unknown
tgctcttgcgtgttaaataaaaatccaaatgatattcttctcgtcgttggaaccaacactttgaatgctggcggagtangatcaaagttgccaaataatcgttcataaccaatttaacccagaacacataccacaataacatcgctttgctaaaaactacatcaaatattgtatacacaaactatgtcaaaccagttggtctggcaagctatgatacaccaattggagcagtatccactctggctggatggggctacttatctaatggtggncaaattcccaactacttgcaaatcgttgacacgt

SEQ ID NO: 1102 - DNA, 243 bp, Ctenocephalides felis
  misc_feature (20)..(20): n = unknown
  misc_feature (24)..(24): n = unknown
  misc_feature (49)..(49): n = unknown
  misc_feature (71)..(71): n = unknown
taatgtcgtgactgacgtantttngatcttcgtttatcttgcagactgncactttagctgccaattccgcnccagtgttgcttgtgcaggtgtcatcattttcgttgcattttacacatttcaggggatcatttttattacataggttactattgcactttagacaagacccaaatgttgcattttcgcattcttttctaatcgaatcagcttcaggtaaatcgaccaaacaacctttttttg

SEQ ID NO: 1103 - DNA, 363 bp, Ctenocephalides felis
  misc_feature (18)..(19): n = unknown
  misc_feature (21)..(21): n = unknown
  misc_feature (30)..(30): n = unknown
  misc_feature (115)..(115): n = unknown
  misc_feature (140)..(140): n = unknown
  misc_feature (197)..(197): n = unknown
  misc_feature (285)..(285): n = unknown
  misc_feature (289)..(289): n = unknown
  misc_feature (294)..(294): n = unknown
  misc_feature (323)..(323): n = unknown
  misc_feature (352)..(352): n = unknown
ttaagagcaattaccccnncnactaacganattacattctcttgaattacttcttattctttggaacctctaaaagttcttccagtagttcatccatagcttctatcaagctagnacgataatttttattggtctccatngagatccaaaacaagtctgctttctcattccattaacagtacgatcaaactcctcanaatcgtgggtcaaaactgccagtatttctggaggcatttgagtaagaggcaatgtcatcaccgcaaaattttacgcacaaacgcaaancatntgtgntatcatcaaactcttggtcaggaattatntcatttacatccaaatgttccttcgtganaatttctacca

SEQ ID NO: 1104 - DNA, 500 bp, Ctenocephalides felis
  misc_feature (26)..(26): n = unknown
  misc_feature (181)..(181): n = unknown
  misc_feature (187)..(187): n = unknown
  misc_feature (209)..(209): n = unknown
  misc_feature (245)..(245): n = unknown
  misc_feature (320)..(320): n = unknown
  misc_feature (351)..(351): n = unknown
  misc_feature (408)..(408): n = unknown
  misc_feature (420)..(420): n = unknown
ctatgcaaggaatataaaattcttgnaaaagtcatttttgtgacaaaacataaaaaatcatttaaaacatatattgctacaaatttaaaatattaagctgatatcaaagaagttgaattgaaagctaacaagtttatttttctgtgatcatttggattcaagttatattatttctatttgngattgnctataaaaacaatgaatattgnttcattgtccctgctaagtcattaatatttcactgnagttattaatttaagtttgattgcatccgttgattttttcccaagaagttaagtctttcctttttttattagtgnttaaataataccttttcgtgaagagaagggntgattgtatatttcatttgactaagaaacctagctgttatgacttccaagaaagccnaacttaacaatnaacttgggaaaattatgaagagattttttaagccagccctaaagtgatggagaagtgaatatttaataaatatctttatg

SEQ ID NO: 1105 - DNA, 365 bp, Ctenocephalides felis
  misc_feature (61)..(62): n = unknown
  misc_feature (73)..(73): n = unknown
  misc_feature (141)..(141): n = unknown
  misc_feature (230)..(230): n = unknown
  misc_feature (318)..(318): n = unknown
tttttttttttttttttttttttgtgagtaaagcacttttaatgcctgctttctttagggnnttctattaagnctccagattgatgcatttgcaacatgatgtcacaaccccctacaaattctccagaaatataaacttgnggaatagtcggccaattggagaaatccttaataccttgtcttaaaacatcatccttcaataccgtcatgactcttatattccacaccgngcatcctcataatttgaaccactgcattgctgaaaccacatttgggggcttcaggaacacccttcatgaaaactaccacttttttgtntttaacaagcttgtttattctatctgagatcgctgttgtgctgcagt

SEQ ID NO: 1106 - DNA, 498 bp, Ctenocephalides felis
  misc_feature (332)..(332): n = unknown
  misc_feature (401)..(401): n = unknown
tggaatgtgaagacgacgtcaacgaatggtttggcccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacnaatgatctgtgcaattaaatataaaaaatatgtataaaaattaaaatgtataaaattgtattttatgtnaggagcacaaacaaaatgtcattaactatagtaatttctgttatttaaaatatataaatatagaagctttatgaaattcatgttctttttaataaaa

SEQ ID NO: 1107 - DNA, 210 bp, Ctenocephalides felis; identical to SEQ ID NO: 416

SEQ ID NO: 1108 - DNA, 500 bp, Ctenocephalides felis
cggatatctggcgtcatatgtggttcccaagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgggaccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgtaac

SEQ ID NO: 1109 - DNA, 340 bp, Ctenocephalides felis
  misc_feature (199)..(199): n = unknown
  misc_feature (244)..(244): n = unknown
  misc_feature (314)..(314): n = unknown
  misc_feature (327)..(327): n = unknown
tttgtttactttatgtgttatataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaagatatagagttaatatnaaaatgaagaaaataaatttaaaagttagaaataatacggacttntaaatgtagggggaagtcccctagtggcggacacctaaagttatttataaataaatcaaaaaatattctnaaaaaaaaaaaanaaaaaaaaaaaaa

SEQ ID NO: 1110 - DNA, 159 bp, Ctenocephalides felis
  misc_feature (124)..(124): n = unknown
ttggggagcctaggttgggccctctttctacgaacgtgctggtcgtgtaaaatgtttgggtaatcctgaacgtgaaggctcagtatcaattgtaggagctgtatcaccgcccggtggtgacttntcagatcccgtcacttcagctacattgggtattgt

SEQ ID NO: 1111 - DNA, 500 bp, Ctenocephalides felis
  misc_feature (222)..(222): n = unknown
  misc_feature (403)..(403): n = unknown
  misc_feature (419)..(419): n = unknown
ttttttttttttttttttttaattacaaaggaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgntttatttgccatttgntggtaaccaagaaacattgataatattttttacaatctcttcgatcggaaaaaacgttttcacttttgcatgcagttctgc

SEQ ID NO: 1112 - DNA, 210 bp, Ctenocephalides felis; identical to SEQ ID NO: 416

SEQ ID NO: 1113 - DNA, 467 bp, Ctenocephalides felis
  misc_feature (429)..(429): n = unknown
  misc_feature (444)..(444): n = unknown
cgatccacgctagaatctcgtgatggtggccttttgtaatgatcgaaatgatctatagaactttgttgaaccaaactcggtctttctcccacttgtcttgaatttctacgcaaattcgtactgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtagtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacatnatctaataaaccacnagtgaaaaaaaaaaaaaaaaaaa

SEQ ID NO: 1114 - DNA, 314 bp, Ctenocephalides felis
  misc_feature (286)..(287): n = unknown
aaatatttggtttctgtttataaaagactaatacaaaccatttaatcattcattttaaaataaaacattcataatatttaagttgtcaggtgaaaactaattgcataattatttaactaaattattgactgttttatttttcgtttgattttgtgctgaaatgatgcaaaaagaataattttgagcaaaacctacctctttttaatttgaaaactatagagtgtattattaatgtttccaattccatagaatgtatatttgtagattagtaaaggtaattaatgcnnaaaaaaaaaaaaaaaaaaaaaaaaaaa

SEQ ID NO: 1115 - DNA, 448 bp, Ctenocephalides felis
ggcgcggccgggtctattacaactaggttaatttgttagtaagttttgttataactgttattgatattaaatatgtattatttttatatatgtaaacgaattataatttttgctctttgattacttctactctggtgcattaacttttattcaactagattaaatttttggtttacttcctatgcctcacatcagtgtccttcatgtgatcaggagtattttttcgatctggactttgatctgtatcactctcctccatttcagctttgttgcgtttcttttcataaatgagaataatcgcgcataaaattattacttcagcacagatacccaaaaatggccacaaagcagctaatttatcttgaactcgaaccaagggtgtagaattaacagtaattccaatgccttgattagtagcaatacatgtatattctcctcgatcgctttt

SEQ ID NO: 1116 - DNA, 498 bp, Ctenocephalides felis
tattacaactaggttaatttgttagtaagttttgttataactgttattgatattaaatatgtattatttttatatatgtaaacgaattataatttttgctctttgattacttctactctggtgcattaacttttattcaactagattaaatttttggtttacttcctatgcctcacatcagtgtccttcatgtgatcaggagtattttttcgatctggactttgatctgtatcactctcctccatttcagctttgttgcgtttcttttcataaatgagaataatcgcgcataaaattattacttcagcacagatacccaaaaatggccacaaagcagctaatttatcttgaactcgaaccaaggttgtagaattaacagtaattccaatgccttgattagtagcaatacatgtatattctcctcgatcgcttttttcagccaaatcaatttccaaagcagaatttggtatattgcatgatctaacaatttgattcgat

SEQ ID NO: 1117 - DNA, 498 bp, Ctenocephalides felis; identical to SEQ ID NO: 1116

SEQ ID NO: 1118 - DNA, 498 bp, Ctenocephalides felis
tatcttttgctaccaatgctcaaaggcgataatggacccacagcctggcgtccaaaatgcttcctcgtccgcaacgacatagtcgttttgcaagatttatccatgtataattttcgccattcgtacccaaaattctctttggatcttgatcatgttaaagttgctttaacggcattggctcgtatgcatgcaagttgcattatctacgagaagaaaaaaaattgttgcatggggagagtttacaaagatcttatgttcgagactatggccaataataatcaatggtggaggactggagaggatactgctttagcaattgctgaggaatctgagaaattcggtaaatataccgaataccattccatggtacaggagaagttaattgatttcctgagattggcatggtctatggtaaaaccatcgcgcatttataaaaatgtggtatgccccgcgatacgcgcaatcacaatttgatgttcaaatataattcaactggct

SEQ ID NO: 1119 - DNA, 428 bp, Ctenocephalides felis
gtattcaatggtatgaattgcttggtgaatgaaaatttcactcatgggttcttcttcgtgttctccatgagctgcttttggcggtgcctttggtgcctctggcataccgttttcttggctggagacaacgtctgaagtcatttccattccttggtttaaatcaccatttgatttagcagaatgaggagcttcatctttatttttcttggttgccatcaaatataatggtttgcctaagagcatgagcggaatacagcagagcccaattaacacaaatattttttgaatttgctgttgtccttcaaacataaattcatcgcattgttctgctggagatccttgcttgaataacatcatgttaatgaacagaatcaaaactgatggtgcgcagcagggttcaaatctgatgtctgtattatttgcagagt

SEQ ID NO: 1120 - DNA, 468 bp, Ctenocephalides felis
  misc_feature (72)..(72): n = unknown
catggacaaattgggagttattcgatgtcttatgtagagtattttgaagtgggtaaataaataatacatcgnctcgcgagtttgttaaagtttgattaaataacttagtgatcattttcaagttattgaattacaacactttgaaagcattaagtgcctttgttagattttaacaatatcaacataataaataattatattaaaaatttatttaattcactcattttaaacaaaataaatttcatatacaatatttaataaatcctgacaaaattgtatttaatttacttgatattttaaataataaatgttttagttagaatattaaggaaacgtatacattaaaataaaatgatatgttcttcacctttatcttttcaataatacgaaattcgaattagtatggcttcgcttaaattaaatatgtttgtctaaactgaccaatcaagaaatcattttaaataaggt

SEQ ID NO: 1121 - DNA, 352 bp, Ctenocephalides felis
atggctacattaaaaatcaaacgattcaatgttttttatgaattgagaaaacaatttatataaaaacgattaactttcattcagaagtttttgttaatataacaatagtatctgaaaaatattaaaaacatctgtcaaaaatatgcaaagtaatttcattcaattataaaaagatttttcaataatttacaaaaattaaaaacatttttgaaaagatatcaatatcagcacatgttaaatagtaagagacaagaaacatgacctttaaaatttaatccgtgttgcatatacaacaatgtattttaaactgtgattttggcaaccatcacttcatttattgcatacgtaatgt

SEQ ID NO: 1122 - DNA, 386 bp, Ctenocephalides felis
cttttatggtgtctttgagaaccaaccaaggacacttctgtggtggttccatcatcagcaatcgttggattcttactgctgctacttgcgtgttaaataaatatccaaatgatattcttctcgtcgttggaaccaacactttgaatgctggcggagtaggatacaaagttgcccaaataatcgttcataaccaatttaaccagaacacataccacaataacatcgctttgctaaaaactacatcaaatattgtatacacaaactatgtcaaaccagttggtctggcaagctatgatacaccaattggagcagtatccactctggctggatggggctacttatctaatggtggcaaattcccaactacttgcaaatcgttgacacgt

SEQ ID NO: 1123 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattcatgtatctttttaataa

SEQ ID NO: 1124 - DNA, 476 bp, Ctenocephalides felis
  misc_feature (12)..(12): n = unknown
  misc_feature (26)..(26): n = unknown
  misc_feature (53)..(53): n = unknown
  misc_feature (366)..(366): n = unknown
gctttttttgancccttggttagcgnggcgcggccgggtaccatcaaatttgnaaggaatcgatcatgttcaaatgcctggaaaagttagcagaaaagcccaagagttgattagaaaactctgtagacctgcacctgcggagagactaggatatcaaaaaaatggattgcaggatgttaaaaaccattcatggtattcatcagtttcattcgactgggtgagtctcaaatctcaagaaatgcctgcgccactggtccgcacagtagaaaattcaacagatatgagaaactttgacaaattcccgaagaacagagaatttccacctgatgaattatcaggtttcgatataaacttttaaaaacactnatttgcacacctgataatgttacataaaatctacgtggctgcagcgctgatataagtaattggtattataaatacagatgtcattcttgaatataagaaattatttatat

SEQ ID NO: 1125 - DNA, 500 bp, Ctenocephalides felis
  misc_feature (146)..(146): n = unknown
  misc_feature (277)..(277): n = unknown
  misc_feature (291)..(291): n = unknown
  misc_feature (308)..(308): n = unknown
  misc_feature (312)..(312): n = unknown
  misc_feature (348)..(348): n = unknown
  misc_feature (357)..(357): n = unknown
  misc_feature (370)..(370): n = unknown
  misc_feature (387)..(387): n = unknown
  misc_feature (398)..(398): n = unknown
  misc_feature (409)..(409): n = unknown
  misc_feature (455)..(455): n = unknown
  misc_feature (462)..(462): n = unknown
  misc_feature (484)..(484): n = unknown
  misc_feature (492)..(492): n = unknown
gtctccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcangtggtatttctgccgcagtctctaagactgtggtagcacccatcgaacgtgtcaaaatgctcctgcaagtcaacacattttcaaacaaattgctgaggataaacgttacaaaggtatcatcgattgctttntacgtatccctaangagcagggcgtactttncttntggcgtggtaacttggccaatggcattcgttatttnccaactcangctttgaacttcncattcaaagacaagtcnagcaagttttnttgggtggagntgcaaagaagaccaatttttgcggtacttccaagaaacttggcatnttgtggngctgctggagcacatattgtgnttcgtctnccacctga

SEQ ID NO: 1126 - DNA, 313 bp, Ctenocephalides felis
aattcttggctataagttcgttgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcgcaactttctttaaccgt

SEQ ID NO: 1127 - DNA, 500 bp, Ctenocephalides felis
cacagtcagtgatagagttacgcgttcgttccgcacttaaccttacgaatacttagattttctttaagaaaatcttctatctaagaagaaagcaaattcaagttgatgcattattctccggaattgttagagaatctgaacaacggttcgttgttcttcagctacgaatacaaccggcactgtaaagggtctttgaagaaactggctcggaagctgctccacgttaggacggccgtgctgaagattgggaacaagtaaagattaccaggaaagggaaacgatgatgaccaggaacagaattataccgcatcttagccaacgtcttcggacatcatgtcaacatcattcatcacaaatatcatcgcagtttaggtagtaatagttaacactttaggataggaaataagcttaaagaagggaacaagaaccatgatcttggaataactgtttctgatttcgtaattgaaaataaaagaaatactgaaggggtacatgttctg

SEQ ID NO: 1128 - DNA, 163 bp, Ctenocephalides felis
tgcttttcattttgattcagtaatagattacttcttgagatagataataatactgtggagaagtaaccttcacatgaaataggcttggttcttataattactggctttgttctggatattagaaatctgatcacaaaattttattaagttattattatgttaa

SEQ ID NO: 1129 - DNA, 496 bp, Ctenocephalides felis
  misc_feature (146)..(146): n = unknown
  misc_feature (195)..(195): n = unknown
  misc_feature (429)..(429): n = unknown
  misc_feature (443)..(443): n = unknown
  misc_feature (448)..(448): n = unknown
  misc_feature (450)..(450): n = unknown
  misc_feature (474)..(474): n = unknown
  misc_feature (480)..(481): n = unknown
ttttttttttttttttttttttttcgacaattttacttgtatttatcttaaacatatttacagtatttcctcaaaaactgttaaatacaataagttaacttaaatacatggatgttctgagaatgtggatgagctcaagattgtanaactgagtttgatctacacaatttttgcctaaaaggttcgactactcanaaagcagccacccgggattccataccgcctcacatttgacaataaaatatatgtataatgttaaataggattttaatggaaaaaagccaatttaatactttagcattatgaatatgtatttccaaattattctataacgaatttaacctaaaatcaagaaatacatattcataaatatacatatattttaatacaaaaaggtaacttgtgcaaaaatgaaattcaaatacactnggttttgctaattnaaatngnttttagatttttctctttttttgntatggnngttattgcttaatta

SEQ ID NO: 1130 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcgcaaacaaaatgtcattaactatagtaatttctgattatttaaaatatataaatatagaagctttatgaaattacatgtatctttttaata

SEQ ID NO: 1131 - DNA, 500 bp, Ctenocephalides felis
  misc_feature (29)..(29): n = unknown
  misc_feature (37)..(37): n = unknown
  misc_feature (86)..(86): n = unknown
  misc_feature (194)..(194): n = unknown
  misc_feature (349)..(349): n = unknown
  misc_feature (442)..(442): n = unknown
  misc_feature (456)..(456): n = unknown
  misc_feature (470)..(470): n = unknown
  misc_feature (485)..(485): n = unknown
tttttttttttttttttttttttcgacanttttactngtatttatcttaaacatatttacagtatttcctcaaaaactgttaaatncaataagttaacttaaatacatggatgttctgagaatgtggatgagctcaagattgtagaactgagtttgatctacacaatttttgcctaaaaggttcgactactcanaaagcagccacccgtggattccataccgcctccatttgacaataaaatatatgtataatgttaaataggattttaatggaaaaaagccaatttaatactttagcattatgaatatgtatttccaaattattctataacgaatttaacctaaaatncaagaaatacatattcataaatatacatatattttaatacaaaaaggtagcttgtgcaaaaatgaaattcaaatacacttggtttgctaattnaaatagttttaganttttctctttttgntatggggggttattnttaattacaacaatt

SEQ ID NO: 1132 - DNA, 500 bp, Ctenocephalides felis
  misc_feature (425)..(425): n = unknown
  misc_feature (485)..(485): n = unknown
tttattttaaatataccttagatgtgtcattttcaactagttggtttaacataatatctatgaaattggtatatgcatcgttaaagcattttttctttattattttaaaatgaaattaaatgtcaaactctaaaattactcactgcaaatcaattctaatgcaggtttatcaaaatgtaaacaaactaaaaatcagatctttacgttttatgatttaacaatacataaccaaagaggttgcacagcaataagcattgtttcatacttcacacataaataaattaaataaaaaagaaaaccaatcctgcagtttttatgcattagaaaatatgtgtgcaacctattttccttatcatttttaaagggggatgtctataaaaatgttattttagcaaacagttatagatattgtattcgctaaaggnatctttgagattcccgagacatgttccactgctcagcagtgctttctgtacggtgtctgnacgggtgccccctct

SEQ ID NO: 1133 - DNA, 457 bp, Ctenocephalides felis
  misc_feature (30)..(30): n = unknown
  misc_feature (119)..(119): n = unknown
  misc_feature (136)..(136): n = unknown
  misc_feature (286)..(286): n = unknown
  misc_feature (346)..(346): n = unknown
  misc_feature (356)..(356): n = unknown
  misc_feature (366)..(366): n = unknown
  misc_feature (402)..(402): n = unknown
  misc_feature (429)..(429): n = unknown
  misc_feature (433)..(434): n = unknown
caggtgcgttcatatctgaattttttttgntaaattatttttaatgtaataaatcataggaatatttatttccaatttgcaaatatggaaactaccatccctatattatatataattgnatatattcctgaactgntttatttgaatttattttaaacacaaactttaattatattcaaataatgatggacgtgatttcatatatccctaaactttggatcagagtttgagagaagcctagccatagtgtatagaaaattatgtgtaggtgtataattaagattgncaggagtcaaatatataaagcattgatacaaattatacattccaattttctgtaaaccgngttctttggntgattatggnttatatcacaatttatgaatcatgtaaattaattgnaaatttgaaatgtatctccgatgtggntgtnnaaaaaaaaaaaaaaaaaaaaaaa

SEQ ID NO: 1134 - DNA, 386 bp, Ctenocephalides felis
atatatcttacatcgaatctaataacaataaagagttattaattttcatgtcgatgttttagaaaatgattcaagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgcctgagttgtgtagggt

SEQ ID NO: 1135 - DNA, 498 bp, Ctenocephalides felis
gggtatctggcgtcatatgtggttcccaagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgggaccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgtaa

SEQ ID NO: 1136 - DNA, 495 bp, Ctenocephalides felis
  misc_feature (165)..(165): n = unknown
  misc_feature (168)..(168): n = unknown
  misc_feature (175)..(175): n = unknown
  misc_feature (177)..(177): n = unknown
  misc_feature (295)..(295): n = unknown
  misc_feature (374)..(374): n = unknown
  misc_feature (377)..(377): n = unknown
  misc_feature (458)..(458): n = unknown
  misc_feature (462)..(462): n = unknown
  misc_feature (489)..(489): n = unknown
ttttttttttttttttttttttctttaatttcataaagcttctatatttatatattttaaataatcagaaattactatagttaatgacattttgtttgtgctccttacataaaatacaattttatacattttaatttttatacatattttttatatttaattgcncanatcattngngtatttattatattaattgactactttatgataatttgaatcctaattagtctattcaagattgttttcctggtttaagccttacttagcaatctcacttttgcattcttcgccgggnggcgtgggtatgcatcgcaactccgttttatcaaagtgcaagccatttggacaatcataatgttttatttgccatttgntgntaaccaagaaacattgataatattttttacaatctcttcgatcggaaaaaacgtttcacttttgcatgcagtctgcacganaaanaatttgggcaaaccattcggtgcgcgnttcaca

SEQ ID NO: 1137 - DNA, 300 bp, Ctenocephalides felis
ctaaaattgtgagcataaatcttcaaagtctctctccaatgtaatctacaggatcaacattcatttataaagatttaatgtttcgagtgcttcgtataatagaacacctataaaaacttttttttgatattcgtgttgatactatataaatttttaaaatcttattttattaattcactcatacttttagcacagatttaatactgcaaaaattcaatcaaatttattatatacagatacaacaatccagcttgtcactactctcactctaaataactacatgactatcaacctctctgt

SEQ ID NO: 1138 - DNA, 430 bp, Ctenocephalides felis
  misc_feature (9)..(9): n = unknown
  misc_feature (17)..(17): n = unknown
  misc_feature (77)..(77): n = unknown
  misc_feature (96)..(96): n = unknown
  misc_feature (126)..(126): n = unknown
  misc_feature (164)..(164): n = unknown
  misc_feature (238)..(238): n = unknown
  misc_feature (263)..(263): n = unknown
  misc_feature (384)..(384): n = unknown
ttttttttntttttttnctaaaatgccttatcatatttgcgagcctgtgttcaaccataatatttttttatataacncataaagtaaaacaaagcncatattttgtatagtttcttttgttgaatncttcatcaatatattaatataatttaggtttcctctcncaagttcctgtgttgcagctttgagtagcttggttaaatactgttccaatcggacattgatcaggaactggctntcctttaggacgtaaacacgtgaanaacttccggcatgttgcgtcgttcttgaaagcaaattttccacgtgctcggcattgcccgacacaggtttcgctccttggggaaaactcggcgggttcttcgcattgcaatacggttcctnttcggccatacatacgacgtccataccccgagtgtgaaaaggcttt

SEQ ID NO: 1139 - DNA, 370 bp, Ctenocephalides felis
ttgagaaagtggaagatcaacaggtggccaaggagcattgcattgcaatggtgcaaagcaaggtattgaaacaattatccatcctggaacaaagacgttcagatgatgaggatatcgttgctgatgttgaatatttgaccgaaaaattacaagcttccattcaagaccttagcttattttgatgaatatgctacagaaatcaagtccggcagattggaatggtcacctgttcacaaatctgctaagttctggagagagaatgccccacgtctcaatgagaagaattatgagttattgcgtatattgatccacttcttgaaagctctcgtgatccccttgtctgctgtagcctgctttgatattggagaag

SEQ ID NO: 1140 - DNA, 500 bp, Ctenocephalides felis
  misc_feature (38)..(38): n = unknown
  misc_feature (117)..(117): n = unknown
  misc_feature (195)..(195): n = unknown
  misc_feature (313)..(313): n = unknown
  misc_feature (318)..(318): n = unknown
  misc_feature (392)..(392): n = unknown
  misc_feature (403)..(403): n = unknown
  misc_feature (448)..(448): n = unknown
  misc_feature (478)..(478): n = unknown
  misc_feature (486)..(486): n = unknown
ttcttacggcccaaacgatttatttttattaaaaaganacatgtaatttcataaagcttctatatttatatattttaaataatcagaaattactatagttaatgacattttgtttgngctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggnggcgngggtatgcatcgcaactccgttttatcaaagtgcaagccatttggacaatcataatgttttatttgccatttgntggtaaccaanaaacattgataatattttttacaatctcttcgacggaaaaaacgntttccttttgcatgcattctgccgagaaanaattgggncaaaccattccgtg

SEQ ID NO: 1141 - DNA, 498 bp, Ctenocephalides felis
tgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgttctgtggccatttttgggtatctgtgctgaagtaataattttatgcgcgattattctcatttatgaaaagaaacgcaacaaagctgaaatggaggagagtgatacagatcaaagtccagatcgaaaaaatactcctgatcacatgaaggacactgatgtgaggcataggaagtaaccaaaaatttaatctagttgaataaaagtaatgcccagagtagaagtatcaaagagcaaaaattattattcgt

SEQ ID NO: 1142 - DNA, 498 bp, Ctenocephalides felis
  misc_feature (55)..(55): n = unknown
  misc_feature (180)..(180): n = unknown
  misc_feature (365)..(365): n = unknown
  misc_feature (409)..(409): n = unknown
  misc_feature (456)..(456): n = unknown
  misc_feature (483)..(483): n = unknown
tgcgagttgtttgcacagttgtaggcaaacctacaccaacagtgtcatggaaagntattaatgagacttatgacgaatcatccgatcgaatcaaattgttagatcatgacaatataccaaattctgctttggaaattgatttggctgaaaaaagcgatcgaggagaatatcatgtattgntactaatcaaggcattggaattactgttaattctacaaccttggttcgagttcaagataaattagctgttctgtggccatttttgggtatctgtgctgaagtaataattttatgcgcgattattctcatttatgaaaagaaacgcaacaaagctgaaatggaggagagtgatacagatcaaaggncagatcgaaaaaatcttctgatccatgaaggcactgtgtgaggnataggaggtaacccaaaaattaatctagtggataaaagttatgcccngagtgaagtatcaaagagccaaaaatntattcgttcattttt

SEQ ID NO: 1143 - DNA, 367 bp, Ctenocephalides felis
  misc_feature (98)..(98): n = unknown
  misc_feature (127)..(127): n = unknown
  misc_feature (143)..(143): n = unknown
  misc_feature (262)..(262): n = unknown
tatgacacaataccagcaacagttgtgacggcttgtgcaatggcccagctgataactaatggggtgttcttggggtctggcaacattccacgagcggngtcatagaatccaaagtatgctgcacggnagatgatgatccttgnacagatactccaaaaccacggtacaatccagggagaccatcagacttgaagattttggtcaagcagttgcccaatccagagaattcacgttgaccagcgcctttacctacatcagcggncaatctggtacgggcgaaatcaagtgggtagacgaagcacaatgatgtgggtcagcagcaccaccagatgccaagtttctgcgaagtacgccagaaatgggtctt

SEQ ID NO: 1144 - DNA, 402 bp, Ctenocephalides felis
  misc_feature (153)..(153): n = unknown
  misc_feature (156)..(156): n = unknown
ttgttctactttgaagttgtgcgctggacaagaaaccccaattacaacaatcaattgtagagactcaaattccgatgctccattttgtgtagatgatatgtgctcatcaaaacctggggaaaactgtaagacggcagaaactacatgcgcggntgnaggatatcagccagaatccgaaagactgcacaagatacttattctgcaaagatggtaaaggtcaggttttcgaatgcccacctaactatgtatatgatcattctaaaaatatgtgtaaaaagaaatcgcagaagctgattgcaccgtcatgaaatgcacaaatccaattcttttatacctatgcaccggcccatcaatttatgcttggtgcaatggcaaaatggacccgatcggcccctgaatggg

SEQ ID NO: 1145 - DNA, 460 bp, Ctenocephalides felis
  misc_feature (392)..(392): n = unknown
taactttataaataccaatcatcatttttatatgatttgtataaaaacttatattccataaaataatttatatatcatgaacatagaaagtgtttatgtatcatttcattcttatatcaatctaaaaattataatattatgaaatataaattttagttgtaaaattgaaatatgtcgaggttataaatcataaaaaattataatataactatacctcctaaaatagcattgccaatagtttgtttatataaacttctggtcgatcgaacttcttttcgttcatttcccgagattaaacatgaaaagcccacggttttcgaatgcattgaataaaatgatttgcttaatcgcagcctaatataatattcatcaggctattatgaaaatattgnatacaatttttatataaaaaccattcatatagaaacatttagaaaaatataaattttatattcggtat

SEQ ID NO: 1146 - DNA, 134 bp, Ctenocephalides felis
  misc_feature (103)..(103): n = unknown
tatatttttggatttacatttcgccaaatttcattcatgtattttttaaggactatttttataccaacttattatattaataaactgattatagattagattnttaaaaaaaaaaaaaaaaaaaaaaaaaaaaa

SEQ ID NO: 1147 - DNA, 242 bp, Ctenocephalides felis
  misc_feature (213)..(214): n = unknown
tataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaagatatagagttaatataaaaatgaagaaaataaaattaaaagttagaaacnnaaaaaaaaaaaaaaaaaaaaaaaaaaaa

SEQ ID NO: 1148 - DNA, 463 bp, Ctenocephalides felis
aatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatccccgccacccggcgaagaatgcaaaagtgagattgctaagtaaggcttaaaccaggaaaacaatcttgaataggctaattaggattcaaattatcataaagtagtcaattaatataataaatcacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaatcaaaaaaaaaaaaaaaaaaaaaaaaa

SEQ ID NO: 1149 - DNA, 372 bp, Ctenocephalides felis
  misc_feature (43)..(43): n = unknown
  misc_feature (181)..(181): n = unknown
  misc_feature (307)..(307): n = unknown
gtttcagggaacgaaaagaatcggccaaatgcatgcaaaaggntgcattaaatatacaactagcagcagccagagtttcaactgatgttggcattaaagtaggagaagccctcagggatgtcgtggaacttcgtttagatttgggaaaatgttcttcagacaatttgaataaatgggaatncagattggaagaaattaatgatgttgtggaaaattgcatcgtgtgaaattgtaacttgaaataatttttcttaactattagttttatagatgaacaaatacataatctaataaaccagcaagtggnctttaaaaaaaaaaaaaaaaaaaaaaaaaaaaaaaaaaaaaaaaaaaaaaaaaaaaaaaaaaaaa

SEQ ID NO: 1150 - DNA, 416 bp, Ctenocephalides felis
  misc_feature (344)..(344): n = unknown
  misc_feature (395)..(395): n = unknown
gaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccccgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtatnaaaattaaaatgtataaaattgtttttatgtaaggagcgcaaacaaaatgncattaactatagtaatttctg

SEQ ID NO: 1151 - DNA, 481 bp, Ctenocephalides felis
  misc_feature (28)..(28): n = unknown
  misc_feature (426)..(426): n = unknown
attgaaagtcaaataataccttgtcagnatggttatgaatatgacagaacatggtatttatcaacggctccgtcagatcaagactgggtttgtgatagagaactctatgtaactaatacatttgctattggacgtgcaggcgaagtcataggcacatttatttttggacaaattaggagataggattggaagaagaccagtattttacttaagtctcatcacaatcgtcaccggaagactaattacagcatttacttccagttggtttattgtttttataacagcggcttttcttggttcactaacatctacatctgtttttcaaagccctttgataattgcgatggaaatatccagaagtgaagatagagcacacattgccatgatgcagtccatcgggtggccagtggaatgattcttatgcgnactgatgtgggcgacgcgagaatggttatctttgctttggtagcactattccatg

SEQ ID NO: 1152 - DNA, 500 bp, Ctenocephalides felis
  misc_feature (43)..(43): n = unknown
  misc_feature (334)..(334): n = unknown
tttatatcacattggtttttattagttttgtggcgttatctgncgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactnaagaaagtcagtctgcaaagtacaaggtttcaaatgtccgtcaccatcgagattttatccaaatataaatgattgtcaaagctattattattgtgacgaaaatagtataggaacccaatattattgcccgcaaattttgcatatgatcccgtacgtcataattgcg

SEQ ID NO: 1153 - DNA, 438 bp, Ctenocephalides felis
  misc_feature (436)..(436): n = unknown
tgagaataaagctcccgctaaaaatactgttctactgctgactttaacacaagcagtcattcctgccaaaaacatccttgatgacaaatctgcagcagctgcggcagatacacaaattgctgtatcagtctttgaccagcctaatgcaaacagatacattgtttgaatagcagaaaaatgctatgtcggagtatagtgcaaatgtcactccaataaccatatttacataaatccagtcttttaacaaagtcaaatccaaaaagtcaacgataacttgcaattttcccctggatttcttctctaccggtgcagtagtgctatcactgacaatgactgctccagtccaattacctaaactagaaatggaagatccacgtcttctcattctatgttcttcatattgaagcatcttaactggagttacgccttctatatncc

SEQ ID NO: 1154 - DNA, 500 bp, Ctenocephalides felis
  misc_feature (364)..(364): n = unknown
  misc_feature (375)..(375): n = unknown
  misc_feature (378)..(378): n = unknown
  misc_feature (384)..(384): n = unknown
  misc_feature (478)..(478): n = unknown
tgagattggcatggtccatggtgaaaccatcgcgcatttataaaaatgtggtatgccaccgcgatacgcgcaatcacaatttgatgttcaaatataattcaactggtctacctgaacaatgcatcttggtcgatttccaaagatgcacctacaatccaccagctttggatttcaatcatcttctatatcagacaacatccagaagctttagagaccagcactatgaggaattgaagaggttctacagagcagcattggtagaaaatatcacgaaggaacatttggatgtaaatgatataattcctgaacaagagtttgatgatagcacagatgatttgcgtttgtgcgctaaaattttggcggngatgacattgnctnttactnaaatgcctccagaaatactggcaggtttgagccacgattctgaggaggttgatcgtctggtaatggaatgagaaagcagactggtttggatctnatggagaacaatgaaaaatatc

SEQ ID NO: 1155 - DNA, 377 bp, Ctenocephalides felis
  misc_feature (158)..(158): n = unknown
  misc_feature (258)..(258): n = unknown
  misc_feature (276)..(276): n = unknown
  misc_feature (316)..(316): n = unknown
  misc_feature (352)..(352): n = unknown
  misc_feature (354)..(354): n = unknown
acctcccatcgtcagtgttatgttattaatccataaaacatttacgctagtatttgaagccaaaaccccgcatatcaccctagtcaatgtgttagatataccaatagttgataacaaccaagctgtttcatcatcggtcattccgctggttttgtttntctgagcaatatataggaatggtattaagtaacccatcatagtaaagaaaccactgaaggcgagcaaaaggaatgacggcgaacgcatcaagttcatatntaacatggtagcgagagntcgacggaacgcttctgggcaaagcttgcaagaagactgntctttgacattcgcccgagtaggtaatctagttacngncatgtggtatccaatagaagtcg

SEQ ID NO: 1156 - DNA, 189 bp, Ctenocephalides felis
  misc_feature (43)..(43): n = unknown
  misc_feature (161)..(161): n = unknown
ggacatgtaactgtatagcattttgtgcccagagccataggtncgcaattatgacgtaacggatcatatgcaaaatttgcggggcaataatattgggttcctatactattttcgtcacaataataatagctttgacaatcatttatatttggataaaatcncgatggtgacggacatttgaaaccttgt

SEQ ID NO: 1157 - DNA, 400 bp, Ctenocephalides felis
  misc_feature (255)..(255): n = unknown
  misc_feature (330)..(330): n = unknown
  misc_feature (363)..(363): n = unknown
  misc_feature (385)..(385): n = unknown
  misc_feature (390)..(390): n = unknown
cactcgtgcagttatatatcgagagctttcagttaactctaatttgtgccagaatgagcgtccaggtttatctacatgccatccatcaggtttataagcaatcctcattcgttctaaatttctagggtttctattgtgaaaaactgtacttactaaggaggcattagtgctgttttgtcgtcactttgattaaataaagtcttcaacattttcacttagtgaaattttgaggttaggttttgattttagtgatgnttaaattgatgtaaaaataatactgcacttttattataagaacttcttatattatataaacaggtatgatcttgnttttgacaaaaggttgtaattattggttttggntatattgagcaaaatccactgntgctncacaagcaag

SEQ ID NO: 1158 - DNA, 500 bp, Ctenocephalides felis
  misc_feature (28)..(28): n = unknown
  misc_feature (37)..(37): n = unknown
  misc_feature (49)..(49): n = unknown
  misc_feature (62)..(62): n = unknown
  misc_feature (121)..(121): n = unknown
  misc_feature (147)..(147): n = unknown
  misc_feature (152)..(152): n = unknown
  misc_feature (235)..(235): n = unknown
  misc_feature (238)..(238): n = unknown
  misc_feature (391)..(391): n = unknown
  misc_feature (430)..(430): n = unknown
  misc_feature (491)..(491): n = unknown
cgctttccgcatctccacaagccaaaancaagcctgngccagcattaanaacccaatccttntcgcgttctttcagcgctatttcagatattaactctgtttctaaccgtctcaatacctnttcaggatcgcgtatggcctcatttntgtgngtcaacctgcggtcaacatcgccaatccatgttaccaatcgatccttacgattagcaaacatttcaccgagtcccaaacgttnttntaacctatggcactgcatagctaattgatggtcaagatcgccatgctgttgccacagaatccaaaccatttgatttattgttttcatatctgctggactaacgcattcttttagttgttcttgagtaactcctaaatcttcaagtttgggtgngagatcaactaaacgagtgcgctgtaatcgtaaattatncagacaattacgcataccggtattagaagatggagaacttgatgaatctattatatgttgnatttcttgg

SEQ ID NO: 1159 - DNA, 335 bp, Ctenocephalides felis
  misc_feature (47)..(47): n = unknown
  misc_feature (78)..(78): n = unknown
  misc_feature (138)..(138): n = unknown
  misc_feature (147)..(147): n = unknown
  misc_feature (167)..(167): n = unknown
  misc_feature (228)..(228): n = unknown
  misc_feature (237)..(237): n = unknown
  misc_feature (277)..(277): n = unknown
  misc_feature (293)..(293): n = unknown
  misc_feature (329)..(329): n = unknown
gaatggtttgacccaaaatctttctcgtgtagaactgcatgcaaaantgaaaacgttttttccgatcgaagagattgnaaaaaatattatcaatgtttcttggttaacaacaaatggcaaataaaacattatgattgnccaaatggnttgcactttgataaaacggngttgcgatgcatacccacgccacccggcgaagaatgcaaaagtgagattgctaagtaaggnttaaaccangaaaacaatcttgaatagactaattaggattcaaattatnataaagtagtcaattnatataataaatacacaaatgatctgtgccatttatnaaaaaa

SEQ ID NO: 1160 - DNA, 500 bp, Ctenocephalides felis
  misc_feature (47)..(47): n = unknown
  misc_feature (464)..(464): n = unknown
  misc_feature (482)..(482): n = unknown
tctataaaattgtatataaaaaatgctgatttataatacaaagcaangcttacattttcgatttgtcacatatatattaacttttttcaaatacaatttatctatgcatttagtttatccattttctaacttacaaaatataattctaaatagttcaataagtaacagaatctaataataacataaaataataatatataacctctggacagtaaacatggcagagattttaaaatgacaaaacacattcttgaaaatgaagttcaaaacaatatctagttttgatcaagagtttctttggttatgactaaagttttcaaacatcacgtaagaatggtaataattgacttgaataatgcttcctatcaatcaatttttatgtaaatcataaaagttaaaattaaacgggaatgtctgttataaaattaactgctcacttccacaaaaatattatttcatctctnaattcacatagataaagnggctttttcacgtgaact

SEQ ID NO: 1161 - DNA, 237 bp, Ctenocephalides felis
  misc_feature (203)..(203): n = unknown
  misc_feature (207)..(207): n = unknown
  misc_feature (237)..(237): n = unknown
tataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaagatatagagttaatataaaaatgaagaaaataaaattaaangccnaaaaaaaaaaaaaaaaaaaaaaaaaaaaan

SEQ ID NO: 1162 - DNA, 441 bp, Ctenocephalides felis
  misc_feature (410)..(410): n = unknown
  misc_feature (422)..(422): n = unknown
gaatgtttatgcaacttgtctttaggcaaagtgctacttacaactttagttaacattcattttgtcatttatattttctgtgacaatccaaaataatacttaaattatttctatcatggcatatgatacgtaagataaaattcacataatctatattattttgctattaatattaacttaattcttaaatttatttcttatttttcatttttaaccacgccatctcggcaagccatggtatacagcaaatgagtaagcacacagtcaaggcatgaaaacatattatgtagctgtgtgttgcatctcgaataaacccaacgattggacccaaagccaatgtcattattccttgcaagaacatgaacagcccgtatgctgaaggaaatctctcctgtgaaaaatattcggcnaatactaaaggnaaaggcacatgaattcatg

SEQ ID NO: 1163 - DNA, 110 bp, Ctenocephalides felis
ggatcgcgaaatagtccaactcttggacaaatgaatggttgctgccaaatacgaacgctgctggaatttgtttcaactggaattagttcttgagactccaaagacaatgt

SEQ ID NO: 1164 - DNA, 484 bp, Ctenocephalides felis
  misc_feature (28)..(28): n = unknown
  misc_feature (284)..(284): n = unknown
  misc_feature (293)..(293): n = unknown
  misc_feature (319)..(319): n = unknown
  misc_feature (358)..(358): n = unknown
  misc_feature (383)..(383): n = unknown
  misc_feature (396)..(396): n = unknown
  misc_feature (409)..(409): n = unknown
  misc_feature (418)..(418): n = unknown
gaatggtttgacccaaaatctttctcgngcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagnagtcaattnatataataaatacacaaatgatctgngcaattaaatataaaaaatatgtataaaaattaaaatgnataaaaatgtttttatgtaaggggnccaaaccaaaagncattaactatagnaatttctgnttatttaaaatatataaatataggaagctttatggaatcaaaaaaaaaaaaaaaaaaaaaaaaaaa

SEQ ID NO: 1165 - DNA, 500 bp, Ctenocephalides felis
  misc_feature (483)..(483): n = unknown
gttcccaagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccggaacttttntggttttctgggatttt

SEQ ID NO: 1166 - DNA, 74 bp, Ctenocephalides felis
caaggtgtattcgacgtggcccgatatgcttgtgcagctgagttatatttcaacagcgttctgcagcagtgcgt

SEQ ID NO: 1167 - DNA, 194 bp, Ctenocephalides felis
tatttgatgtttctaatggagtatttgttgaagtattttggcttaagggttgtgattcggtgaggtttccattgctttcattcacgtttgaacttggagcagttgtggatgggcttatttcatcattcgttgactgtggttggtcgtctttaacgtcactgttaagcaaacgcctgggcccagggtcagtctgt

SEQ ID NO: 1168 - DNA, 480 bp, Ctenocephalides felis
  misc_feature (152)..(152): n = unknown
  misc_feature (270)..(270): n = unknown
  misc_feature (273)..(273): n = unknown
  misc_feature (275)..(275): n = unknown
  misc_feature (334)..(334): n = unknown
  misc_feature (471)..(471): n = unknown
taatttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggnggngngggtatgcatcgcaactccgttttatcaaagtgcaagccatttggacaatcataatgtntttatttgccatttgttgttaaccaagaaacattgataatattttttacaatctcttcgatcggaaaaaacgttttacttttgcatgcagttctgcacgagaaagattttgggcaaaccattcgttgacgcgtcttncatttcagt

SEQ ID NO: 1169 - DNA, 190 bp, Ctenocephalides felis
  misc_feature (5)..(5): n = unknown
  misc_feature (16)..(16): n = unknown
catcntagattttatncaaatataaatgattgtccaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgctttcgt

SEQ ID NO: 1170 - DNA, 327 bp, Ctenocephalides felis
  misc_feature (11)..(11): n = unknown
  misc_feature (25)..(25): n = unknown
  misc_feature (37)..(37): n = unknown
  misc_feature (50)..(50): n = unknown
  misc_feature (66)..(66): n = unknown
  misc_feature (143)..(143): n = unknown
  misc_feature (186)..(186): n = unknown
  misc_feature (200)..(200): n = unknown
cttcaacgttnttcctaagtatggngttgctttattngggggttggaggnatgtttttagtgaccntaaattcctcctcaggatcccaaataactaaatcagcatccaagccttctttgatttgtccttttatgccatccagnccagttaatttcgcaggtcccgcagataataaacgagaacatnatgagctttaaagnccctttagaagcaccggtccataataaagataatccaaattgcataccagcaattccaccccatgcttttaggaaatcaggatgacaaccattgcacaggcctttcagtgcagcaggcgatggtgaa

SEQ ID NO: 1171 - DNA, 469 bp, Ctenocephalides felis
  misc_feature (397)..(397): n = unknown
  misc_feature (441)..(441): n = unknown
  misc_feature (454)..(454): n = unknown
gaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgncattaactatagtaatttctgattatttaaaatatataaatatngaagctttttggntttaaaaaaaaaaaa

SEQ ID NO: 1172 - DNA, 189 bp, Ctenocephalides felis
ggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgt

SEQ ID NO: 1173 - DNA, 199 bp, Ctenocephalides felis
  misc_feature (176)..(176): n = unknown
atcaggtaaccgctaacagaagttatcacagtgacgttctacatcggagaatggttagaattcagaaaataatcatgcaacacggtctcattattataacattcacataaaaaatatttaaaatatgtaaactagcttgcatgtttattgtaagccagtctataatctattattgnttgcactttacttaaatttaagt

SEQ ID NO: 1174 - DNA, 500 bp, Ctenocephalides felis
  misc_feature (17)..(17): n = unknown
  misc_feature (40)..(40): n = unknown
  misc_feature (84)..(84): n = unknown
  misc_feature (312)..(312): n = unknown
  misc_feature (314)..(314): n = unknown
  misc_feature (331)..(331): n = unknown
  misc_feature (384)..(384): n = unknown
  misc_feature (451)..(451): n = unknown
  misc_feature (468)..(468): n = unknown
  misc_feature (475)..(475): n = unknown
  misc_feature (478)..(479): n = unknown
  misc_feature (487)..(487): n = unknown
  misc_feature (489)..(489): n = unknown
  misc_feature (493)..(493): n = unknown
ttttacgtccaaaccgnggagtttccaatataccacatgncattattcgtttactattcttatccttaatatttatagcactgncgtaataattctttgtaaaatgagccatatctctgttgagagtcataccgtaatcatatcgacattgatatgattctccacataaatcttcagcacgattgatgtcgctacttctgtttgatggaagaaaatctttaggttctttaacccagtttggtataaatgaggaatttgcataataactggctgtgcgaccaaattcacgagtgaagagtgccgctccgaggngntcattttcacgatcccncagcatccagtgacgtgcgaaatctttatgaacagattcaaaactggtgagantaacaggcacaaaaggtccatcagggttgcaaagcgctgcatatccaactcaattttcgagagacanaggtttattaataatgncatgggnaannaacttacngncatnaatcctg

SEQ ID NO: 1175 - DNA, 500 bp, Ctenocephalides felis
  misc_feature (4)..(4): n = unknown
  misc_feature (159)..(159): n = unknown
  misc_feature (195)..(195): n = unknown
  misc_feature (275)..(275): n = unknown
  misc_feature (280)..(280): n = unknown
  misc_feature (389)..(389): n = unknown
  misc_feature (401)..(401): n = unknown
  misc_feature (436)..(436): n = unknown
  misc_feature (459)..(459): n = unknown
ttgnaaaagtcatttttgtgacaaaacataaaaaatcatttaaaacatatattgctacaaatttaaaatattaagctgatatcaaagaagttgaattgaaagctaacaagtttatttttctgtgatcatttggattcaagttatattatttctatttgngattggctataaaaacaatgaatattggttcattgntccctgctaagtcattaatatttcactgtagttattaatttaagtttgattgacatccgttgattttttccacaagaagntaagnctttcttttttttattagtggttaaataataccttttcgcgaagagaaggggtgattgtatatttcatttgactaagaaacctagctgttatgactttcaagaaagccnaacttaacaatnaacttggaaaaattatgaagagattttttaaagcnagccctaaagtgattggagaagngaaatatttaataatatctttatgtgaataataggtatttg

SEQ ID NO: 1176 - DNA, 416 bp, Ctenocephalides felis
  misc_feature (135)..(135): n = unknown
  misc_feature (142)..(142): n = unknown
  misc_feature (220)..(220): n = unknown
  misc_feature (222)..(222): n = unknown
  misc_feature (229)..(229): n = unknown
  misc_feature (238)..(238): n = unknown
  misc_feature (257)..(257): n = unknown
  misc_feature (260)..(260): n = unknown
  misc_feature (279)..(279): n = unknown
  misc_feature (286)..(286): n = unknown
  misc_feature (359)..(359): n = unknown
  misc_feature (384)..(384): n = unknown
  misc_feature (408)..(408): n = unknown
gaatggtttgacccaaaatctttctcgggcagaactgcatgcaaaaggtgaaaacgttttttccgatcgaagagattggaaaaaatattatcaatggttcttggttaacaacaaatggcaaataaaacattatgnttggccnaatggcttgcactttggataaacgggaggttgcgatgcatacccacgccccccgcgaagaatgcaaaagtgagattgntnagtaggnttaaaccangaaaacaatcttggatagnccnattagggatcaaaatattntaaaggnggtcatttaatataataaatccccaatggatctggggcatttaaatttaaaaatatgtataaaaattaaatgnataaaatggtttttatgtaggggcncaaccaaatggtcattactatagnattctgat

SEQ ID NO: 1177 - DNA, 332 bp, Ctenocephalides felis
  misc_feature (38)..(38): n = unknown
  misc_feature (109)..(109): n = unknown
  misc_feature (152)..(152): n = unknown
  misc_feature (218)..(218): n = unknown
  misc_feature (282)..(282): n = unknown
gcatagataaatgtgtgtcaaatttaaaacactattgnaaatttaatatattttctatattcacattttcattatatttctaatctaatatccccaaatttcaactaanaagttaaatcctttgccagtctgagaagataggagtaaagttncatttttccagccaactccaccattgacaagagtggcatagcctccttggccatttacatattggnccagggcacgtacacaactgattgtgcgattatttcttgaacccactggtggaaatgacacttntctggtagctttcctgaaaaagcttccacttttggattggacttgtcggt

SEQ ID NO: 1178 - DNA, 128 bp, Ctenocephalides felis
aaatctttaagctagtgttcgcaaactatcgatactatcgatggtttcagacttttttctttcataaatacttttttgtgatatgaacatacttcgcaaaaattaaatttgacagaaaacatttaagt

SEQ ID NO: 1179 - DNA, 101 bp, Ctenocephalides felis
ttaaaatttggtctgttcgaccattaattcttacatgatctgagttcaaaccggtttaagccaggttggtttctatccttaattttttaaaattaattagt

SEQ ID NO: 1180 - DNA, 389 bp, Ctenocephalides felis
  misc_feature (27)..(27): n = unknown
  misc_feature (30)..(30): n = unknown
  misc_feature (193)..(193): n = unknown
  misc_feature (220)..(220): n = unknown
  misc_feature (253)..(253): n = unknown
  misc_feature (333)..(333): n = unknown
tttttttacatttttatttcttttganggnttaattcaatatatatgtatatttataaaaagtattcaaaacactatatccaagcatttatcaacgtagaagcagaacaaattcactacacatgtagatttttaagggacaaatagcaccataacatatgtcgcaaatcattggtttatatgattaacaatgntaactttgtcatacaaaggatcgcttntatagatttcatatcttaaatattatcaacgcntgcaaatataaataagtgattaaattaatcaagaagttcacatagattttgtttaacatgatacacatgcaactattttntcaaacaaaattcatatttactatttacagggaaaaaacttatataaatatgttgt

SEQ ID NO: 1181 - DNA, 500 bp, Ctenocephalides felis
caaggctgcctctacttttggaagtaaaatgaatcatatggacatgaatatcaagtttagaaagataaatacacaaataatagattccaatagtaagaattaagtaaaatatgaagccatatgtacatattatattcacaataatctaatcttccaagttgcggaatgcttgctgtaaatcctcatgtaattgatcaaaatcactcttgatctttgcctcaccatccttgactgggtccttgaacttcattgaggacaactgatatagaatattgcccatagcatctctaatggtattccaggtaatcttgttttcactttgtgcagtagattcaactgcgtattttgccatatcatagaaagcaataatgttacgtaacataccaactgttttatagaaggggcagaaacgatcatatgatgagtagctgtctgctgtaggaaatcgctttcaagagcttggcacttcaagtgtgatcttgtcagtttccgccaaggag

SEQ ID NO: 1182 - DNA, 290 bp, Ctenocephalides felis
  misc_feature (62)..(62): n = unknown
aacaaccaaattactttgacgttacggccggcagaggagcaagactacagcgccatgtcggnggtcgtgtgcggtgtctgaatcaacaattacaatgcaaataaataaaaaaataaaaaatgtattaataaagactaatggagctttgcaacaatcatcgggaatccaaaattagatttatactcactccaataagtgaataagaaattatttttatttacttcttggaattgaatatgaatcttgattttgattatgctacatttatgatgttttggacctgaatacgt

SEQ ID NO: 1183 - DNA, 434 bp, Ctenocephalides felis
  misc_feature (55)..(55): n = unknown
ggggtagttcttggaaaatttcttgacttccctgtgatacatttcctgagcccgngaacacgaacgtcaatggacctacagattttggcatcatacctaaagcgatttcatatccagcatcccttatggattgtctggccatggaggaatttctgtaattgtgagccaatccaatatgcatgaaaggtgtatgatgacccaaagctaaaagacgtaaacctaatccgtgcaaaatattgatcataccggcaacaccagcatattttccaaatgctactactctttggcccttttcgtccatcaacttttcataatcgataagacgaatattcttttccataattgcatcaagtaaaggcatattagattcttgggctttgataacatgtgaaaacatgcagtaggttttattgggaattaattgttctacaggt

SEQ ID NO: 1184 - DNA, 500 bp, Ctenocephalides felis
ctgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgcccccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgttctttttaataaaa

SEQ ID NO: 1185 - DNA, 498 bp, Ctenocephalides felis
  misc_feature (467)..(467): n = unknown
ttggaattcttgacgaaattcgagaagaactttatctcacagggtaattatgagaaccgcacagtatttgaatctttggacattggctggcaattgttgcgtatcttccccaaggagatgttgaagagaatacccgcttccaccctcgccgagttttacccacgtgattctcgtcattaaaaatcttactaaagtttccatcaataccatattttatttccctttatatgttgtcttctccatgtaaagaatattaaatcagtttttgggatgtctggtactaaccacatccttaatgtaaggaaaacatgaagacatgttttaatgtttaaagaaattgtagatacttataaaataatgattctattgttaaaatgaaagtatgttgttgtgaaacagtattctgccgtctagctacaagttgttgaaatattattaaattttattattatatttggtttttctgnatgggtttaaactcattccatgataattttc

SEQ ID NO: 1186 - DNA, 240 bp, Ctenocephalides felis
gggggacaaggttttcaaatgttccgtcaccatcgagattttatccaaatataaatgattgtcaaagctgttattattgtgacgaaaatagtataggaacccaatattattgccccgcaaattttgcatatgatccgttacgtcataattgcggacctatggctctgggcacaaaatgctatacagttacatgtcctgcacagcctaaggtgctttcgtacattggtgataaatcattgt

SEQ ID NO: 1187 - DNA, 235 bp, Ctenocephalides felis
  misc_feature (33)..(33): n = unknown
  misc_feature (64)..(64): n = unknown
  misc_feature (157)..(157): n = unknown
aacatttcagactttgcacgtccagactgcttnatcatacgcctacgggacagtgtcgaatggntatgacacaataccagcaacagttgtgacgggctttgtgcaatggcccagctgataactaatgggggtggttctttggggtctggcaacattncacgagcggtgtcatagaaatccaaagtatgctgcacggtagatgatgataccttgacagatacttcaaaaccacggt

SEQ ID NO: 1188 - DNA, 498 bp, Ctenocephalides felis
  misc_feature (425)..(425): n = unknown
ttggaattcttgacgaaattcgagaagaactttatctcacagggtaattatgagaaccgcacagtatttgaatctttggacattggctggcaattgttgcgtatcttccccaaggagatgttgaagagaatacccgcttccaccctcgccgagttttacccacgtgattctcgtcattaaaaatcttactaaagtttccatcaataccatattttatttccctttatatgttgtcttctccatgtaaagaatattaaatcagtttttgggatgtctggtactaaccacatccttaatgtaaggaaaacatgaagacatgttttaatgtttaaagaaattgtagatcttataaaataatgattctattgttaaaatgaaagtatgttgttgtgaaacagtattctgccgtactagctacaagttgntgaaatattattaaattttattattatatttggttttttctggtggtttaaactcattccatgataattttca

SEQ ID NO: 1189 - DNA, 260 bp, Ctenocephalides felis
  misc_feature (26)..(26): n = unknown
  misc_feature (74)..(74): n = unknown
  misc_feature (251)..(251): n = unknown
ttcccggggcatattttacatgaatnagaagttggcattacaatcgtaccctgatctggattggcatcctcgangtaatggaaccttttttaatttttggatagcaagcggcctttgggattcatacaaactttggtcttcgtcttttctgcatctttgaaacattcggttcttagttctggaagtttttgaacgttacaacccgatttctcgcaacacattttttctcggttagtcgagtcacaactttntttaaccgt

SEQ ID NO: 1190 - DNA, 420 bp, Ctenocephalides felis
  misc_feature (34)..(34): n = unknown
  misc_feature (59)..(59): n = unknown
  misc_feature (75)..(75): n = unknown
  misc_feature (104)..(104): n = unknown
  misc_feature (128)..(128): n = unknown
  misc_feature (135)..(135): n = unknown
  misc_feature (155)..(155): n = unknown
  misc_feature (257)..(257): n = unknown
  misc_feature (259)..(259): n = unknown
  misc_feature (264)..(264): n = unknown
  misc_feature (291)..(291): n = unknown
  misc_feature (299)..(299): n = unknown
  misc_feature (309)..(309): n = unknown
gctatatttatatattttaaataatcagaaattnctatagttaatgacattttgtttgngctccttacataaaanacaattttatacattttaatttttatacntattttttatatttaattgcccanatcattngggtatttattatattaatngactctttatgataatttgaatcctaattagtctattcaagattgttttcctggtttaagccttacttagcaatctcacttttgcattcttcgccggggggngngggtntgcatcgcaactccgttttatcaaagngcaagccntttggacaancataatgttttatttgccatttgttgttaaccaaaaaacattgataatattttttcaatctcttcgatcggaaaaaacgttttcacttttgcatgcagttctgcacgagaa

SEQ ID NO: 1191 - DNA, 361 bp, Ctenocephalides felis
  misc_feature (31)..(31): n = unknown
  misc_feature (105)..(105): n = unknown
  misc_feature (135)..(135): n = unknown
  misc_feature (173)..(173): n = unknown
ttttttttttttttttttttttgagcagatnaaaaaatatattaatttaataatatataatagtaacatataaagaatacattgatttaacaattgataatcatnttcacataacacataattataagctatcgnaatttttagaaaatgagttgactttaaatataaatacncaaattttcatatttttaagaacacaattatgttcaagaacttcacatatcaagatactacctcagctttacagcataattggggatcttctatatcttttttactttggattaattttagctcaatatatttcatgttggaagtatcacctccagctaagtttgaatattctagagttcgttttagt

SEQ ID NO: 1192 - DNA, 210 bp, Ctenocephalides felis
ggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggcgacggacatttgaaaccttgt

SEQ ID NO: 1193 - DNA, 367 bp, Ctenocephalides felis
  misc_feature (66)..(66): n = unknown
  misc_feature (349)..(349): n = unknown
tgataaattgcctgcaagaatgagtttcagggaacgaaaagaatcggccaaatgcatgcaaaaggntgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaactttaaaaaaaaaaaaaanaaaaaaaaaaaaaaaaaa

SEQ ID NO: 1194 - DNA, 498 bp, Ctenocephalides felis
cacggaggatattggagaaagctcccttgaagaaggcaccacttccttctgtcttggcaatggtggcccagcagtgcagtgttcccttgtacaacatttcagactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggtacaatccagggagaccatcagacttgaagattttggtcaagcagttgcccaatccagagaattcacgttgaccagcgcctttacctacatcagcggccaatctggtacgggcaaaatcaagtgggtagacgaagcacaatgatgtggcttcagcagcaccaccagatgccaagtttt

SEQ ID NO: 1195 - DNA, 425 bp, Ctenocephalides felis
  misc_feature (16)..(16): n = unknown
  misc_feature (28)..(28): n = unknown
  misc_feature (62)..(62): n = unknown
  misc_feature (295)..(295): n = unknown
cagtttttgctaggcntaatgctttttnaaacatttcaattgcacgctcaagattccctcgntgaacctcaatagttcctaaagtttcatagccaaattcacatttgggatcaagtgaaatagcttcattaatcaattgaactgcagtatcaacatcacctgtccattgcaaccttagtaatcctttatgaacataaacaatagcattattaggctcaatttcaatggctttagagaaatatgaatctgctttggagtattgtctttgatcacaaagcacttgtgcatataaagnatagcactctatacagagaggaaattttttaatggcattgtaaaggcccaattatttcttttgccttattcatgtccttaacagcaaaagcatatcgatggccgtatatattttttggacataagcaata

SEQ ID NO: 1196 - DNA, 343 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaaaaaaaaaaaaaaaaaaaa

SEQ ID NO: 1197 - DNA, 207 bp, Ctenocephalides felis
  misc_feature (35)..(35): n = unknown
  misc_feature (127)..(127): n = unknown
  misc_feature (134)..(134): n = unknown
  misc_feature (161)..(161): n = unknown
  misc_feature (169)..(169): n = unknown
  misc_feature (195)..(195): n = unknown
ccaaaatcattttgaacgagatggaacttgcgcangagctcacatggaatctttagttgatggtaaaataaaattcagacatgtcatggaagaaaatggaaaaaaagttgaatttagtggacaactnagacgtnatgatgaacattccggtaatggatatntgagaatnagttatgaagatacaaatcgagaatnagattatatagt

SEQ ID NO: 1198 - DNA, 92 bp, Ctenocephalides felis
caaacgaattacaacaagtggaaaccactgtaataacaaacgaaaagtgctacgaattgtctcaattcgttgaaccaacttcgcaaatatgt

SEQ ID NO: 1199 - DNA, 232 bp, Ctenocephalides felis
  misc_feature (65)..(65): n = unknown
  misc_feature (104)..(104): n = unknown
  misc_feature (130)..(130): n = unknown
aaagtgatttaccagagaagtttgtgaaagacttgggtgtcctcaacgctttatcagacaaagtnttggaattaacccccgatgaacgccctagcctgttcttnttccgcttatcaacaaatttcaaatnccccgaagacaccgacaaagccaaaacagagctcaccaaagccatcaaaaccttgagcgaggcttttgataaaacctacgaaggcaaagtgctgttcaccgt

SEQ ID NO: 1200 - DNA, 500 bp, Ctenocephalides felis
  misc_feature (66)..(66): n = unknown
  misc_feature (383)..(383): n = unknown
  misc_feature (430)..(430): n = unknown
  misc_feature (480)..(480): n = unknown
gggtaacatatttattagaatgttttatatcacattggtttttattagttttgtggcgttatctgncgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtcagtctgcaaagtcaaggnttcaaatgtccgcaccatcgagattttattcaaatataaatgattgncaaagctattattattgtgacgaaaatagtataggacccaatattattgncccccaaattttgcatatga

SEQ ID NO: 1201 - DNA, 498 bp, Ctenocephalides felis
tatcagtatcacccttacgtgaatactccgaaaaaatcattgaagcacgaagaacagaagcaccttacttactaccaccgcttttaagccactacgatagttcccaaacaagacctttatccagcttgcagcatctcatgatcgatcaaaacactttaatcgaaggcttgaaattggttggtgtcgatggatcttcattaaaacaactagctcactttgcacattgcccgataactatgaacatgggtcacagacatagttgggtcgaggctggcacttctttaggaagtgctacggatttgagctctttaaacaacgatgtggatagcgcaacaagttcaccaggattatccaggaaaattaacaccgaagaatattcttttgatgtcatgaaacgagcagtaaatgaacaaactgagtctgaacaattactgcaagaggaacaatataaacgacttgccaaagcgtttagaaatgaaccatttgatgaattgtgcc

SEQ ID NO: 1202 - DNA, 305 bp, Ctenocephalides felis
  misc_feature (89)..(89): n = unknown
cgttacttccaaccatttttgcaataattttaactatgtcttattatatccctttgtgcatatagggtttaaactgactaacaagtatnacttttttttataaatatccaagtatcatacgacacacgtttataacgatttcataaattaaatatcactgtttgtttttgtacaaaggcactttttgtcttcaagcacacacgaggctttaaactaccaatgtaatatttgactagaataattttaattgtttcagcgtccactgaaggctttaagcaacttcgtgccaaacagactctctgtcg

SEQ ID NO: 1203 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaataaaaaaaaaaaaaaaaaaa

SEQ ID NO: 1204 - DNA, 498 bp, Ctenocephalides felis
gggtatctggcgtcatatgtggttcccaagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgtaa

SEQ ID NO: 1205 - DNA, 269 bp, Ctenocephalides felis
  misc_feature (30)..(30): n = unknown
  misc_feature (59)..(59): n = unknown
agatctactaatgccgcgtttaccactgtnacagcaattccgcaaaccagcaaccacanatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1206 - DNA, 452 bp, Ctenocephalides felis
tttcttttaaattcgtccatgagatgatctactagacgattgtcaaaatcttcaccgcctagatgagtatcaccggcagttgctctgacttcaaatagagatccttcatcaattgttaaaacagatacatcaaatgtgcctccaccgaggtcaaatattaacacattcctttctccttgtaggtgtttatctaagccatatgccaaagcagcagctgttggttcgtttataacccttaaaacattcaaacctgcaatgacaccagcatcttttgtagcttgccgttgagagtcattgaaataagcaggaacagtaataactgcatctttcactttctctccaagatagttttcagctgtttctttcatcttaactagcaccattgcactaatttcttctggtgaaaagcgtttcagttggttcttgtattcaacttcaattttaggtgttgt

SEQ ID NO: 1207 - DNA, 313 bp, Ctenocephalides felis
aattcttggctataagttcgtcgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 1208 - DNA, 498 bp, Ctenocephalides felis
  misc_feature (302)..(302): n = unknown
aataaatcatggtctgaagagacaaataagattgaaagtcaaataataccttgtcagcatggttatgaatatgacaagaacatggtatttatcaacggctcccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgcaccggaagactaattacagcatttacttcagttggtttattgnttttataacagcggcttttcttggttcactaacatctacatctgtttttcaaagccctttgataattgcgatggaaatatccagaagtgaagatagagcacacattggcatgatgcagtccatcgggtggccagtggaatgattcttatgcccgtactgatgtgggccacccagaatgggttattttgctttggta

SEQ ID NO: 1209 - DNA, 500 bp, Ctenocephalides felis
  misc_feature (466)..(466): n = unknown
  misc_feature (494)..(494): n = unknown
aatttttagttattaattaataacgaagtcatcattaatgaaataattaatgaacgactttaggataattatttatatacatttttataagaaaagactcattattttataagtatttaaatttcaaaatcaagtttttgggatggagcagaagaataaatatatttattatatcgcccgactgttatacgatgagattttcttatgaaagtggttccctggtcgtgttaggcaaaaatagacacatcagaccacctccagccaatagtagtgctacaataaatgtcggggctggacaatacatgtctaataaagttgcaattaccacattgccaattatgcctccaagtcgagcagctaccatagatattgcacaccagtagccctcaaatttgttggaaacacctcggtgataagacagtccaacgctgcatttccacaagatataacagagctgaagactgcngacacgattaaattgtgacgtttattgnaaacaa

SEQ ID NO: 1210 - DNA, 285 bp, Ctenocephalides felis
tgctgctttctgctagtgaggtatttgctgtttctaatggagtatttgttgaagtattttggcttaagggttgtgattcggtgaggtttccattgctttcattcacgtttgaacttggagcagttgtggatgggcttatttcatcattcgttgactgtggttggtcgtctttaacgtcactgtctgggaaagcaatagtaaaagtatgattatgagtgaatatttatttgctcgactattattattatcttactaagcaaacgcctgggcccagggtcagtctgt

SEQ ID NO: 1211 - DNA, 313 bp, Ctenocephalides felis
  misc_feature (51)..(51): n = unknown
  misc_feature (66)..(66): n = unknown
aattcttggctataagttcgttgcatgttttgcaagtgatttgtttattgnatttattcccgtggnatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 1212 - DNA, 303 bp, Ctenocephalides felis
  misc_feature (302)..(302): n = unknown
atttctattgactgggataaagtaactaaaaaggctgataaggtgacagataaaattgaagaggctgttactggagaaactcccaaattaatggataaaattgagagatttgttgataggaaaattgacaaagcagaggaattgctaaagaaaaatcaaagaaaagccaaaaaatggtatcacggtcttacaggtgaagaagaatttaaattgcaagaaatacatatttttataggagcatttgcagctggtgctgctttgggtattgcagctgcttaggaaaagcacacattttgatgtant

SEQ ID NO: 1213 - DNA, 305 bp, Ctenocephalides felis
  misc_feature (300)..(300): n = unknown
cgttacttccaaccatttttgcaataattttaactatgtcttattatatccctttgtgcatatagggtttaaactgactaacaagtatcacttttttttataaatatccaagtatcatacgacacacgtttataacgatttcataaattaaatatcactgtttgtttttgtacaaaggcactttttgtcttcaagcacacacgaggctttaaactaccaatgtaatatttgactagaataattttaattgtttcagcgtccactgaaggctttaagcaacttcgtgccaaacagactctntgtcg

SEQ ID NO: 1214 - DNA, 320 bp, Ctenocephalides felis
  misc_feature (9)..(9): n = unknown
  misc_feature (19)..(20): n = unknown
  misc_feature (40)..(40): n = unknown
  misc_feature (42)..(42): n = unknown
  misc_feature (44)..(44): n = unknown
  misc_feature (82)..(82): n = unknown
  misc_feature (257)..(257): n = unknown
ttttttttnttttttgagnnatttataaataactttaggngngncgccactaggggacttccccctacatttagaagtccgnattatttcttacttttaattttattttcttcatttttatattaactctatatctttatctatctatctattagttcaaccaataaaattaagcgtgaaatgaataattttgattagaacaaatatattcatggatttaaaaaaatctaaattgtaaaattcttaaatgccttatnatatttgcgagcctgtgttcaaccataatatttttttatataacacataaagtaaaacaaagt

SEQ ID NO: 1215 - DNA, 498 bp, Ctenocephalides felis
  misc_feature (401)..(401): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtnaggagcacaaacaaaatgtcattaactatagtaatttctgattatttaaaatatataaatatagaagctttatgaaattcatgtatctttttaataa

SEQ ID NO: 1216 - DNA, 288 bp, Ctenocephalides felis
ctgcttgatatcaggtttaatgagggaatggaatctgcaattctggttgcaaggctaatgctattaccactgagctactaaacaaacttaaccataattttaaattatattatttggggctgagtatatatatattttaacttttgtgttttctatatttcgtttcaccatccaaacagtgtttctcaaactttttacaatctttatcttttatctatacatatttggtgatgcttttatgtcttgaattcagttttacctcagatcaaattcagtttgcttgatagt

SEQ ID NO: 1217 - DNA, 287 bp, Ctenocephalides felis
  misc_feature (26)..(26): n = unknown
  misc_feature (34)..(34): n = unknown
  misc_feature (54)..(54): n = unknown
  misc_feature (62)..(63): n = unknown
tgcttgatatcaggtttaatgagggnatggaatntgcaattctggttgcaaggntaatgctnntaccactgagctactaaacaaacttaaccataattttaaattatattatttggggctgagtatatatatattttaacttttgtgttttctatatttcgtttcaccatccaaacagtgtttctcaaactttttacaatctttatcttttatctatacatatttggtgatgcttttatgtcttgaattcagttttacctcagatcaaattcagtttgcttgatagt

SEQ ID NO: 1218 - DNA, 466 bp, Ctenocephalides felis
  misc_feature (26)..(26): n = unknown
  misc_feature (49)..(49): n = unknown
  misc_feature (52)..(52): n = unknown
  misc_feature (134)..(134): n = unknown
  misc_feature (300)..(300): n = unknown
  misc_feature (445)..(445): n = unknown
tttttttttttttttttttttttttnctgattagaacaaatatattcanggntttaaaaaaatctaaattgtaaaattcttaaatgccttatcatatttgcgagcctgtgttcaaccataatattttttttatntaacacataaagtaaaacaaagtacatattttgtatagtttcttttgttgaatacttcatcaatatattaatataatttaggtttcctctcgcaagttcctgtgttgcagctttgagtagcttggttaaatactgttccaatcggacattgatcaggaactggctntcctttaggacgtaaacacgtgaagaacttccggcatgttgcgtcgttcttgaaagcaaattttccacgtgctcggcattgcccgacacaggtttcgctccttggggaaaactcggcgggtcttcgcattgcaatacgggtcctntttcggccatacatacgacgt

SEQ ID NO: 1219 - DNA, 310 bp, Ctenocephalides felis
  misc_feature (227)..(227): n = unknown
  misc_feature (230)..(230): n = unknown
  misc_feature (239)..(239): n = unknown
gggcgaaatcaagtgggtagacgaagcacaatgatgtggctccagcagcaccaccagatgccaagtttcctgcgaaggaacgccagaattgggtcttcttgtcaaggtatcatcatctaccgtgcagcatactttggattctatgacaccgctcgtggaatgttgccagaccccaagaacaccccattagttatcagctgggccattgcgcaagccgtcacaactgntgntggtattgngtcatatccattcgacactgtccgtaggcgtatgatgatgcagtctggacgtgcaaagtctgaaatgttgt

SEQ ID NO: 1220 - DNA, 167 bp, Ctenocephalides felis
  misc_feature (97)..(97): n = unknown
ttgtctttgaatgcgaagttcaaagcctgagttgggaaataacgaatgacattggccaagttaccacgccagaaggaaagtacgccctgctccttanggatacgtacaaagcaatcgatgatcctttgtaacgtttatcctcagcaatttgtttggaaatgtgttgt

SEQ ID NO: 1221 - DNA, 369 bp, Ctenocephalides felis
tgataccactgcacaacttcttaccgaaggatgtttgcaaactttgtcctcgatgtcacttggatttacatatattcctttgtatttagcaatctccttaacacgatcggttatatagacataaccgtcttcgtcgtaataaccgacgtctccggttttgaaccaaccggtttgtgcgtccaaaaccgaatcggttgcctcttggttgccaaaatagcccaacatggttgggccacaaaggtagatctctccttgtttgtttgggccaagatttaggcctgtatccatgtctactatcttcagttctgtgttgacacaaacaaagccaatagtatttggcctatattcaggacaatccaaagtaattgt

SEQ ID NO: 1222 - DNA, 371 bp, Ctenocephalides felis
  misc_feature (7)..(7): n = unknown
  misc_feature (20)..(21): n = unknown
  misc_feature (40)..(40): n = unknown
  misc_feature (45)..(45): n = unknown
  misc_feature (240)..(240): n = unknown
ttttttnttttttttatatnnaattgcacagatcatttgngtatntattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgntaaccaagaaacattgataatattttttacaatctcttcgatcggaaaaaacgttttcacttttgcatgcagttctgcacgagaaagattttgggtcaaaccattcgttgacgtcgtcttcacatttcagt

SEQ ID NO: 1223 - DNA, 386 bp, Ctenocephalides felis
  misc_feature (58)..(58): n = unknown
cctacacaactcagggcaatggcagtatgtatatctttaatgatgggtcgattaggangtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcgattacaaagaaaattcagaagttgctactgaatcattttctaaaacatcgacatgaaaattaataactctttattgttattagattcgatgtaagatatatgt

SEQ ID NO: 1224 - DNA, 428 bp, Ctenocephalides felis
  misc_feature (296)..(296): n = unknown
cgtattcaatggtatgaattgcttggtgaatgaaaatttcactcatgggttcttcttcgtgttctccatgagctgcttttggcggtgcctttggtgcctctggcataccgttttcttggctggagacaacgtctgaagtcatttccattccttggtttaaatcaccatttgatttagcagaatgaggagcttcatctttatttttcttggttgccatcaaatataatggtttgcctaagagcatgagcggaatacagcagagcccaattaacacaaatattttttgaatttgctgntgccttcaaacataaattcatcgcattgttctgctggagatccttgcttgaataacatcatgttaatgaacagaatcaaaactgatggtgcgcagcagggttcaaatctgatgtctgtattatttgcagagg

SEQ ID NO: 1225 - DNA, 407 bp, Ctenocephalides felis
  misc_feature (6)..(6): n = unknown
  misc_feature (32)..(32): n = unknown
  misc_feature (38)..(38): n = unknown
  misc_feature (40)..(40): n = unknown
  misc_feature (57)..(57): n = unknown
  misc_feature (234)..(234): n = unknown
  misc_feature (300)..(300): n = unknown
  misc_feature (303)..(303): n = unknown
ttttgncacttttttttatttcatcaactacngggaantnggaacaaataaagaacnattattcttaaattaaagggaaattttacatcatacattcaacatgaatcaattctaaaattatgtgaataacccaaattttaaaccattaacacaaatattttttattcccacttaacttattacttattaaaatattacttggcaagtatttttatattttggatttttttaggnatattataaagacgcctttagttggtgccttatgaataaaatacatatttataatacattcacatnttntatactaaactattgagaagacttagacgatttaatggaattaatatgaaggaatttattaaattaaattttataaatataaaaaattttagtgctttttttaa

SEQ ID NO: 1226 - DNA, 500 bp, Ctenocephalides felis
  misc_feature (48)..(48): n = unknown
  misc_feature (52)..(52): n = unknown
  misc_feature (194)..(194): n = unknown
  misc_feature (223)..(223): n = unknown
  misc_feature (246)..(246): n = unknown
  misc_feature (255)..(255): n = unknown
  misc_feature (258)..(258): n = unknown
  misc_feature (421)..(421): n = unknown
  misc_feature (424)..(424): n = unknown
cttaaaacaaagaaaattagttcaaatatttttcaattcttagtttgngtgngcatatattgattatttagaaatctttataaacaataggacacttacatttcaaaaataggtgttacgaataaattatgatctctttcactacatatattacaatcaacatttattaaataagtgttgaatttatttattgngcaaataataatatgctttccatgtttgnaatcaatttattaatttaattgnataatttgntgntttacctacacattttagctactggtaagctaggcataatgtgaaatgtatatcttaatttttttgagatcaaaagctttcaatttaattaaaaatgaaatttattaataaatatgtgcaattttccaattattgtgatgcctagttatgcctatgataatgntgnaatcataatattttgaataatcgattttatatgatctctatatgtgcgaatattttaacaaactataaatgtttta

SEQ ID NO: 1227 - DNA, 265 bp, Ctenocephalides felis
  misc_feature (60)..(60): n = unknown
  misc_feature (233)..(234): n = unknown
catataaattgttgaagaaaagttgtttatttgtatttatttgtaaatattgttaaaggntaaatatataaagattggttttatgggttatatgtctaacatttattttgtaacatacagttaagaacacaatagaaaaatcatttaattagttggatatttttagtataagtattcctgtgtagatagcaagttgtgactacagaataaatatctgattttatcacaaggtnnaaaaaaaaaaaaaaaaaaaaaaaaaaaaaaa

SEQ ID NO: 1228 - DNA, 487 bp, Ctenocephalides felis
  misc_feature (61)..(61): n = unknown
  misc_feature (70)..(70): n = unknown
  misc_feature (478)..(478): n = unknown
  misc_feature (484)..(484): n = unknown
gatggggaagacgacgtcaacgaatgggtttgacccaaaatctttctcgtgcagaactgcntgcaaaagngaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttttggggnaaaaanaaa

SEQ ID NO: 1229 - DNA, 221 bp, Ctenocephalides felis
ttgcaggagcaatttgacacgttcgatgggtgctaccacagtcttagagactgcagcagaaataccacctgcggcgaaatccttggcgaaagccactgggtctgcaagtgcgggcatcatcttgaaaaagtttacttaatttaacacgggcggcaacaataaattaaataaaactcttttgcaaactcgacccgatatagcagggtctggagacggtaggc

SEQ ID NO: 1230 - DNA, 408 bp, Ctenocephalides felis
  misc_feature (11)..(12): n = unknown
  misc_feature (35)..(35): n = unknown
  misc_feature (38)..(38): n = unknown
  misc_feature (120)..(120): n = unknown
  misc_feature (144)..(144): n = unknown
  misc_feature (168)..(168): n = unknown
ttttttttttnnctgattagaacaaatatattcanggntttaaaaaaatctaaattgtaaaattcttaaatgccttatcatatttgcgagcctgtgttcaaccataatattttttttatntaacacataaagtaaaacaaagtncatattttgtatagtttcttttgntgaatacttcatcaatatattaatataatttagggttcctctcgcaagttcctgtgttgcagctttgagtagcttggttaaatactgttccaatcggacattgatcaggaactggctctcctttaggacgtaaacacgtgaagaacttcggcatgttgcgtcgttcttgaaagcaaattttccacgtgctcggcattgcccgacacaggtttcgctccttggggaaaactcggcgggttc

SEQ ID NO: 1231 - DNA, 500 bp, Ctenocephalides felis
  misc_feature (59)..(59): n = unknown
ttttttttttttttttttttaatttcataaagcttctatatttatatattgtaaataancagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgcgcttcacattttaag

SEQ ID NO: 1232 - DNA, 211 bp, Ctenocephalides felis
  misc_feature (27)..(27): n = unknown
  misc_feature (56)..(58): n = unknown
  misc_feature (64)..(64): n = unknown
  misc_feature (187)..(187): n = unknown
  misc_feature (196)..(196): n = unknown
  misc_feature (208)..(208): n = unknown
caaggtttcaaatgtccgtcaccatcnagattttatccaaatataaatgattgtcnnngctatnattattgtgacgaaaatagtataggaacccaatattattgccccgcaaattttgcatatgatccgttacgtcataattgcggacctatggctctgggcacaaaatgctatacagttacatgtnctgcacagnctaaggtgcttncgt

SEQ ID NO: 1233 - DNA, 451 bp, Ctenocephalides felis
  misc_feature (10)..(11): n = unknown
  misc_feature (13)..(13): n = unknown
  misc_feature (34)..(34): n = unknown
  misc_feature (37)..(37): n = unknown
  misc_feature (119)..(119): n = unknown
  misc_feature (143)..(143): n = unknown
  misc_feature (430)..(430): n = unknown
tttttttttnncngattagaacaaatatattcanggntttaaaaaaatctaaattgtaaaattcttaaatgccttatcatatttgcgagcctgtgttcaaccataatattttttttatntaacacataaagtaaaacaaagtncatattttgtatagtttcttttgttgaatacttcatcaatatattaatataatttaggtttcctctcgcaagttcctgtgttgcagctttgagtagcttggttaaatactgttccaatcggacattgatcaggaactggctctcctttaggacgtaaacacgtgaagaacttccggcatgttgcgtcgttcttgaaagcaaattttccacgtgctcggcattgcccgacacaggtttcgctccttggggaaaactcggcgggttcttcgcattgcaatacgggtctntttcggccatacatacgacgt

SEQ ID NO: 1234 - DNA, 500 bp, Ctenocephalides felis
  misc_feature (450)..(450): n = unknown
gctgggtaacatatttattagaatgttttatatcacattggtttttattagttttgtggcgttatctgtcgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtcagtctgcaaagtcaaggtttcaaatgtccgttccatcgagattttatccaaatataaatgattgcaaagctattattattgnggcgaaaatagtataggaaccccatattattgccccaaatttgcatatga

SEQ ID NO: 1235 - DNA, 498 bp, Ctenocephalides felis
  misc_feature (57)..(57): n = unknown
  misc_feature (65)..(65): n = unknown
atttgtcttcaaactgtttggagatgacagttactcggacattctcaggtataaatncatcaacngttgactctataagtttagggtcccagtgtgtcattagcgaaggaccgcaaagaacctcttcaaatttaaaatgcatcagattcttggctagataaacaacataacttcttggttgttctttatctctgaacttaaagttcatatcgttaattgcctttgattcatcaaatatccatttttgtggtgtttcctttttcagcaaattaatatactgaaaaactagtctgactatatcatcaacatggtttacgccctcttctgttaaatctgcatctagtttgaagaaaccaaatcccctcctctgaacagcaccgcaagataagcttgaactccaaccacgtgctttcaaacatgataagagactgccgggtccctcatgcccaaaaagatgacctaaataatttcctggtgcagattttctaaaaggctcaa

SEQ ID NO: 1236 - DNA, 230 bp, Ctenocephalides felis
  misc_feature (3)..(3): n = unknown
  misc_feature (7)..(7): n = unknown
  misc_feature (17)..(17): n = unknown
  misc_feature (22)..(22): n = unknown
  misc_feature (35)..(35): n = unknown
  misc_feature (40)..(40): n = unknown
  misc_feature (43)..(43): n = unknown
  misc_feature (80)..(80): n = unknown
  misc_feature (83)..(83): n = unknown
  misc_feature (141)..(141): n = unknown
  misc_feature (210)..(210): n = unknown
gcnatgntttattaccnatgtncgggagcccttangctgngcnggacatgtaactgtatagcattttgtgcccagagccntangtccccaattatgacgtaacggatcatatgcaaaatttgcggggcaataatattgggntcctatactattttcgcacaataataatagctttgacaatcatttatatttggataaaatctcgatggngacggacatttgaaaccttg

SEQ ID NO: 1237 - DNA, 498 bp, Ctenocephalides felis
  misc_feature (254)..(254): n = unknown
ttaaaacaaagaaaattagttcaaatatttttcaattcttagtttgtgtgtgcatatattgattatttagaaatctttataaacaataggacacttacatttcaaaaataggtgttacgaataaattatgatctctttcactacatatattacaatcaacatttattaaataagtgttgaatttatttattgtgcaaataataatatgctttccatgtttgtaatcaatttattaatttaattgtataatttgntgttttacctacacattttagctactggtaagctaggcataatgtgaaatgtatatcttaatttttttgagatcaaaagctttcaatttaattaaaaatgaaatttattaataaatatgtgcaattttccaattattgtgatgcctagttatgcctatgataatggtgtaatcataatattttgaataatcgattttatatgatctctatatgtgcgaatattttaacaaactataaatgtttt

SEQ ID NO: 1238 - DNA, 498 bp, Ctenocephalides felis
  misc_feature (67)..(67): n = unknown
  misc_feature (445)..(445): n = unknown
cagaagtttacttacataacttgagtgggaaacttattccaaaaagatgtatttacgtttgcatatngtagaataagatttaatatgtaatattacatggaacttaatttttaattgtatatcaatctttagtataagcaagactacgaggacgtattttaatgtatattaaaaatgatgtgtataatcattatttctatttaattcaaaagagtatatattgaaatatctatattaaacaaatattataaaaataatcatatataaattataacagcattctattttattccaatggcatgagcattcaggacgtaaagtgattaacaggtttcgatcaaaatagaattctatagtttttgttctaaaagaaacgaaattttaaaaaaattatgttattcggaggtttttattacagctattaaatttttttaactttagccgntatgtaatttagaaatataagaatattttaaatattcataaattatatcaaat

SEQ ID NO: 1239 - DNA, 331 bp, Ctenocephalides felis
atggaatagtgctaaccaaagcaaagataaaccaatctcgcgtcgcccacatcagtaacggcgtaagaatcattccactggtccacccgatggactgcatcatggcaatgtgtgctctatcttcacttctggatatttccatcgcaattatcaaagggctttgaaaaacagatgtagatgttagcgaaccaagaaaagccgctgttataaaaacaataaaccaactggaagtaaatgctgtaattagtcttccggtgacgattgtgatgagacttaagtaaaatactggtcttcttccaatcctgtctcctaattgaccaaagataaatgt

SEQ ID NO: 1240 - DNA, 384 bp, Ctenocephalides felis
  misc_feature (90)..(90): n = unknown
ttttttttttttttttttttttgaatgctgtatataacctttatttatggatgcatagatagatgtgtgccaaatttaaaatactattgnatatttaattttttttctatattcacattttcattatatttctaatctaatatccccaaatttcaactaagaagttaaatcctttgccagtctgagaagataggagtaaagttacatttttccagccaactccaccattgacaagagtggcatagcctccttggccatttacatattggtccagggcacgaacacagctaattgtgcgattatttctcgatcccactggtggaaatgacacctctctagtagctttcctgaaaaagtttccactcttggattggacttgacggt

SEQ ID NO: 1241 - DNA, 118 bp, Ctenocephalides felis; identical to SEQ ID NO: 471

SEQ ID NO: 1242 - DNA, 425 bp, Ctenocephalides felis
  misc_feature (58)..(58): n = unknown
  misc_feature (352)..(352): n = unknown
tcaatggtaacgtttcagcagcaaaccaataattagtaacatctagaaaaggagctgntaatgacaaagctgctaaaaaacaggtatgtcttaaagcaactcttctacataatgcaggatcagtaactgccatcattctatacccagctctactgtaatccggtcttaaattccaagataatgcattaaaatgtggaaattgccacgtatataaaagacctcctaagataaatgctcctgcacttaaattaccggaacaagcagcccaacccattaggggtgggattgctccgacgattgatccaacccaagtattcagaatacttattcttttcattggagtatatacggnggtatataatattaaattagctgctcctaatcctgctgttaaaccatttacaccaaaatataacatacctatc

SEQ ID NO: 1243 - DNA, 328 bp, Ctenocephalides felis
  misc_feature (40)..(40): n = unknown
  misc_feature (65)..(65): n = unknown
tttgttttactttatgtgttatataaaaaaatattatggntgaacacaggctcgcaaatatgatnaggcatttaagaattttacaatttagatttttttaaatccatgaatatatttgttctaatcaaaattattcattttacgcttaattttattggttgaactaatagatagatagataaagatatagagttaatataaaaatgaagaaaataaaattaaaagtaagaaataatacggacttctaaatgtagggggaagtcccctagtggcggacacctaaagttatttataaataaatcaaaaaaaaaaaaaaaaaaaaaaaaaa

SEQ ID NO: 1244 - DNA, 468 bp, Ctenocephalides felis
tttcaccaattacaaagtaaatctttcaggaaatcaatcagaaattattaatttatgagtataccgagttgctctatggacttaagatgttagacaaagttgtaaattatttaatttcaaacaaatttgccaaatatttcattcaaattaaacaaaccattcaaaagttacaagaattttaaagttagtaaacattgcgacaaccgtagtgtcgacatcaatttaaaattattaatttttcagtataccgagttgctctatggacttaggatgttagaaaaagttatagactatttaattttgaacaaatttgccaaatatttcatttaaattaaacaagcagtttaaaagttacaagaatttgaaagttagtaaacattgcgacaacgtagggtcgacatcaattaaaaattattaaattatgagtatccgagttgatgtaaggacttttggtaaaagacaaagttg

SEQ ID NO: 1245 - DNA, 472 bp, Ctenocephalides felis
ttttttttttttttttttaagtatttatttattctctttataattttgaacattgacggcattaacattttttacctatgagtatgtacatatatcttacatcgaatctaataacaataaagagttattaattttcatgtcgatgttttagaaaatgattcagtagcaacttctgaagtttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgcctggttgtgagggt

SEQ ID NO: 1246 - DNA, 131 bp, Ctenocephalides felis; identical to SEQ ID NO: 515

SEQ ID NO: 1247 - DNA, 498 bp, Ctenocephalides felis
  misc_feature (179)..(179): n = unknown
  misc_feature (182)..(182): n = unknown
  misc_feature (251)..(251): n = unknown
  misc_feature (492)..(492): n = unknown
atttgtcttcaaactgtttggagatgacagttactcggacattctcaggtataaattcatcaacaattgactctataagtttagggtcccagtgtgtcattagcgaaggaccgcaaagaacctcttcaaatttaaaatgcatcagattcttggctagataaacaacataacttcttggntgntctttatctctgaacttaaagttcatatcgttaattgcctttgattcatcaaatatccatttttgtggngtttcctttttcagcaaattaatatactgaaaaactagtctgactatatcatcaacatggtttacgccctcttctgttaaatctgcatctagtttgaagaaaccaaatcccctcctctgaacagcaccgcaagataagcttgaactccaaccacgtgctttcaaacatgataagagactgccgggtccctcatgcccaaaaagatgacctaaataatttcctgggcagattttctaaaagntcaagg

SEQ ID NO: 1248 - DNA, 292 bp, Ctenocephalides felis
atttttttataaataaacgtgatttgcctagcagtcttataaaatacagttcaacaattccttatacttatcagtgctttctaaaataacatacataatttaaatcaaaattaaatacgagtaacaaaagtagtaaacaaatagaattagttctaatcttcttacacctaaaaactattttagataaattgagtagatcgccattttcttttaatttaataaattcttttttatgatgtattaaatattcatatatcgtttatttaaatgtttccggtatcttataatttgt

SEQ ID NO: 1249 - DNA, 310 bp, Ctenocephalides felis
  misc_feature (59)..(59): n = unknown
aacatttcagactttgcacgtccagactgcatcatcatacgcctacggacagtgtcgantggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgacaagaagacccaattctggcgttacttcgcaggaaacttggcatctggtggtgctgctggagccacatcattgtgcttcgtctacccacttgatttcgcccgt

SEQ ID NO: 1250 - DNA, 428 bp, Ctenocephalides felis
  misc_feature (413)..(413): n = unknown
cgacaagtccaatccaagagtggaaactttttcaggaaagctactagagaagtgtcatttccaccagtgggatcgagaaataatcgcacaattagctgtgttcgtgccctggaccaatatgtaaatggccaaggaggctatgccactcttgtcaatggtggagctggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatacagcattcaaaaaaaaaaaaaaaaaaaaaaaaaaaaaaaaggaaaggaaaaaaaaaaaaanaaaaaaaaaaaaaaa

SEQ ID NO: 1251 - DNA, 173 bp, Ctenocephalides felis
  misc_feature (9)..(9): n = unknown
  misc_feature (98)..(98): n = unknown
aataatggnggtgctttacgccacataaagaaaaggtttatggtggcacataaatacaagaattattacaagcacaagccaaggtcgggaccatttgntctggtaaaaaatataaaatatcgacacactttttggggggggagggggattcacaaaatcgaacattattatgt

SEQ ID NO: 1252 - DNA, 498 bp, Ctenocephalides felis
aagttttcgcagtttacaaatccagaagagataccagagcaacttcaacatcagatcagtgagtgcagttcacaattaagaatgtctagttcagagctaacaaagctgctatcgtcattatcaagcatattgagcgatcaatcatatatccaacagcttctcgatatcaacgataccatcactgagatgtcagaagttgaaaattgaaagtcatcaacaaatgccatgtcatcaaagaatggcacgtcataaataattttattaaattctttttaaaatttatgtattattaaattgtaatgtctaatgcttcatattagtattaagttttcaaatttttatgtttttttttgtattgtattaatagtttacttatttttcttattttgatatacctggtaatttgtaacttataaagaagcttaagctcgtataaaactatctttatatttatcaatgcttatgtattttaaaacaaaaataaaatgctttgaaagg

SEQ ID NO: 1253 - DNA, 150 bp, Ctenocephalides felis
cgcgctaaaggggaattcacttaaatctttaagcgagtgtttgcaaactatcgatactatcgatggtttcagacttttttctttcataaatacttttttgtgatatgaacatacttcgcaaaaattaaatttgacaaaaaaaatttaagt

SEQ ID NO: 1254 - DNA, 498 bp, Ctenocephalides felis
  misc_feature (63)..(63): n = unknown
  misc_feature (245)..(245): n = unknown
  misc_feature (254)..(254): n = unknown
  misc_feature (257)..(257): n = unknown
  misc_feature (420)..(420): n = unknown
  misc_feature (423)..(423): n = unknown
ttaaaacaaagaaaattagttcaaatatttttcaattcttagtttgtgtgtgcatatattgantatttagaaatctttataaacaataggacacttacatttcaaaaataggtgttacgaataaattatgatctctttcactacatatattacaatcaacatttattaaataagtgttgaatttatttattgtgcaaataataatatgctttccatgtttgtaatcaatttattaatttaattgnataatttgntgntttacctacacattttagctactggtaagctaggcataatgtgaaatgtatatcttaatttttttgagatcaaaagctttcaatttaattaaaaatgaaatttattaataaatatgtgcaattttccaattattgtgatgcctagttatgcctatgataatgntgnaatcataatattttgaataatcgattttatatgatctctatatgtgcgaatattttaacaaactataaatgtttt

SEQ ID NO: 1255 - DNA, 307 bp, Ctenocephalides felis
tggcgacacctgactactctcacaccggtgagctacaaacgctcaacatgaagctaagaaatactctagatttatatgccaatgttgttcatgttaaaagtttgccaggagttcgctctaggcataagaatattgactgtgtaatcattcgtgaacaaactgagggagagtatagtgctttggagcacgaaagcgttacaggagttgtagaatgtttaaaaattataacagctaagaaatctgaaaggattgccaaattcgcttttgactatgcaacaaagcacaatcgaaagaaggtgactgctgt

SEQ ID NO: 1256 - DNA, 427 bp, Ctenocephalides felis
  misc_feature (295)..(295): n = unknown
gtattcaatggtatgaattgcttggtgaatgaaaatttcactcatgggttcttcttcgtgttctccatgagctgcttttggcggtgcctttggtgcctctggcataccgttttcttggctggagacaacgtctgaagtcatttccattccttggttcaaatcaccatttgatttagcagaatgaggagcttcatctttatttttcttggttgccatcaaatataatggtttgcccaagagcatgagcggaatacagcagagcccaattaacacaaatattttttgaatttgctgntgtccttcaaacataaattcatcgcaatgttctgctggagatccttgcttgaataacatcatgttaatgaacagaatcaaaactgatggtgcgcagcagggttcaaatctgatgtctgtttatttgcagagt

SEQ ID NO: 1257 - DNA, 498 bp, Ctenocephalides felis
  misc_feature (329)..(329): n = unknown
  misc_feature (405)..(405): n = unknown
  misc_feature (466)..(466): n = unknown
ataaaaaaaatcacaataaatagatagttttaacacctatcaacttaaaattatgtgatacaagcttaaactttgcgtattatgtaaaattaaaatatacaaaaaatatactttgagtaaatatgttgtcaatgatatatcattgatatagaaggctttttatcagctttttataaatttcgataacacagatattgataaataaattacatgtgacccggcaatgcttgaggtccctgcataaatatatttgaccccattcgctgctgatattgcacactttgttgggattcatcgttaggattagaatggcttgatgtaggtatggntcccatgccatttgtaatatgcaatccatttaaatgttgagacatttgatgtattaacataggattagggcctggntgtggtgcctattggttgaggattattcgctagggacatttgagaactggtctgaatcaantgcatttggggctgactttgatttactattgc

SEQ ID NO: 1258 - DNA, 345 bp, Ctenocephalides felis
  misc_feature (16)..(16): n = unknown
  misc_feature (75)..(75): n = unknown
gcgtggtcgcgggcgngtctgaagcactttaaacaaactcagaattatcgatgatattttggaaatgcaaaaaanggctgatgagctaatattattggcacctcttaaatcagtcgtaaccattgaaacacttcgcaaaatgtcaaaaaaaggattgacttatgagatacttaaaaaagcttacgaaggaaagggagaagagggccttgaacaaattttgaaaactaaagtaacaaaggcaaagcttactataaacaatgttgtggtgttttttcaaaaacatgcaaatgatgtttaatgacccttatttatcagaaatatattataaatatttaacattttagt

SEQ ID NO: 1259 - DNA, 498 bp, Ctenocephalides felis
  misc_feature (73)..(73): n = unknown
tgaaatgtgaagacgacgtcaaccgaatgggtttgacccaaaatctttctcgtgcagaactgcatgcaaaagngaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgttctttttaata

SEQ ID NO: 1260 - DNA, 422 bp, Ctenocephalides felis
  misc_feature (42)..(42): n = unknown
  misc_feature (70)..(70): n = unknown
aaataatcagacatcagatttgaaccctgctgcgcaccatcnattttgattctgttcattaacatgatgntattcaagcaaggatctccagcagaacattgcgatgaatttatgtttgaaggacaacagcaaattcaaaaaatatttgtgttaattgggctctgctgtattccgctcatgctcttgggcaaaccattatatttgatggcaaccaagaaaaataaagatgaagctcctcattctgctaaatcaaatggtgatttgaaccaaggaatggaaatgacttcagacgttgtctccagccaagaaaacggtatgccagaggcaccaaaggcaccgccaaaagcagctcatggagaacacgaagaagaacccatgagtgaaattttcattcaccaagcaattcataccattgaatacgt

SEQ ID NO: 1261 - DNA, 498 bp, Ctenocephalides felis
  misc_feature (57)..(57): n = unknown
  misc_feature (65)..(65): n = unknown
  misc_feature (163)..(163): n = unknown
  misc_feature (255)..(255): n = unknown
  misc_feature (318)..(318): n = unknown
  misc_feature (454)..(454): n = unknown
ttgaaattttatgtgtaattatatttattatgttagtaaacaagtgaaacaacctgngaagtggnggatcctataaagcagcggtttccaaccttttttgcatcgcgcccccctgcaaatataaaaaaaaattgctgcggccccccttattttttttaactgnttaattttataaatactcaactgatattatcagactacaaattaatatgcaatattatgtaaaaatattcataaaaactaaatattttttgnttattttttaataacgttctataaatggtggggtattttcgataatagtaatctggaaacagntgttcgcgccccccttaggacagcctggcgccccactgagggggcgcgccccacagggtggaaaccgctgctataaagtattggttaatctgaatggttatatatattggattttcaagaatatcggcactatggnatttcttaccacattcatactatacaatataaaaatattgcatt

SEQ ID NO: 1262 - DNA, 397 bp, Ctenocephalides felis
  misc_feature (38)..(38): n = unknown
  misc_feature (62)..(62): n = unknown
  misc_feature (67)..(67): n = unknown
  misc_feature (77)..(77): n = unknown
  misc_feature (316)..(316): n = unknown
  misc_feature (371)..(371): n = unknown
cccggcagggaccctacacaacttagggcaatggcagnatgtatatctttaatgatgggtcnattangaagggttgntggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattcaaagaaaattcagaagntgctactgaatcattttctaaaacatcgacatgaaaattaataactctttattgntattagattcgatgtaagatatatgt

SEQ ID NO: 1263 - DNA, 419 bp, Ctenocephalides felis
  misc_feature (29)..(29): n = unknown
  misc_feature (33)..(33): n = unknown
  misc_feature (304)..(304): n = unknown
  misc_feature (334)..(334): n = unknown
  misc_feature (377)..(377): n = unknown
tgatttactggaaaccagacaaacattgntaancttagtaagtttaaattcaatcttgaatcaggctaacagtgaacatgaacagacgtaaggagaaaaacaattttacttgcggaggactatgaggaatggagacaattaccaaataacgaagggattgtataagggtgaattaaggataccgaagtggataggtaaggttttcaggactagttgtccccgcttcctgaggctcatctccatcaccctgcgtgtctgatgtcacagtgttaaagttatctcgcagcaattgcattatgagagntgaatctttatatgaatcttcatttagggnatcgagctctgctatcgcatcatcgaatgcctgtttcgcaagntgcacgctttatcaggtgaatttagtatttcataataaaata

SEQ ID NO: 1264 - DNA, 425 bp, Ctenocephalides felis
  misc_feature (24)..(24): n = unknown
  misc_feature (35)..(35): n = unknown
  misc_feature (49)..(49): n = unknown
  misc_feature (72)..(72): n = unknown
  misc_feature (89)..(89): n = unknown
  misc_feature (105)..(105): n = unknown
  misc_feature (141)..(141): n = unknown
  misc_feature (152)..(152): n = unknown
  misc_feature (164)..(164): n = unknown
  misc_feature (171)..(171): n = unknown
  misc_feature (220)..(220): n = unknown
  misc_feature (225)..(225): n = unknown
  misc_feature (242)..(243): n = unknown
  misc_feature (282)..(282): n = unknown
  misc_feature (316)..(316): n = unknown
  misc_feature (346)..(346): n = unknown
  misc_feature (382)..(382): n = unknown
  misc_feature (393)..(393): n = unknown
  misc_feature (395)..(395): n = unknown
tccgcgactcataaagaattattnaaacaatgaanggtaaaaaaaaggnaagtttggggaaataatatatgnattggattaacttaagntaattctccctcgcanttttatactatagtaaccagaaacaaaaatcagagnggggaaaatgnaaattcatatantttgggnaaaatacaatcaagatataacagggccacaatattattaaaataccgtntttgngacgaaacctaaagtgnngtcagaatataaaaaacaataatatttataccttcaaanggatgctttgaaaaaaagcattcgaagattttgnttaaatattttggtaagtccacatttatgnttggtcggtcaattaaattatgtttcttttgcaagnaagaatatgtngnagatattgcacaaaattagtatattttatg

SEQ ID NO: 1265 - DNA, 500 bp, Ctenocephalides felis
  misc_feature (32)..(32): n = unknown
  misc_feature (51)..(52): n = unknown
  misc_feature (62)..(62): n = unknown
  misc_feature (118)..(118): n = unknown
  misc_feature (407)..(407): n = unknown
  misc_feature (438)..(438): n = unknown
  misc_feature (481)..(481): n = unknown
caaaactcgatagttacgcgactcataaatanttatttaaacaatgaatgnnaaaaaaaagnaaagtttgtaaatataatatatgtattggattaacttagttaattctccctcgcanttttatactatagtaaccagaaacaaaaatcagagtgtgtaaaatgtaaattcatatatttttggtaaaaatacaatcaagatataacagtgccacaatattattaaaatacgtatttgtgacgaaacctaaagtgtagtcagaatataaaaaacaataatatttataccttcaaatgtatgctttgaaaaaaagcattcgaagattttgtttaaatattttgttaagtccacatttatgtttgtcgttcaattaaattatgtttcttttgcaagtaagattatgttgnagatattgcacaaaattagtatattttatgnaattttaagcatattggtattttttggaaaatcggactattgncaccaaaattaaataaatg

SEQ ID NO: 1266 - DNA, 227 bp, Ctenocephalides felis
gtggcttaagggttgtgattcggtgaggtttccattgctttcattcacgtttgaacttggagcagttgtggatgggcttatttcatcattcgttgactgtggttggtcgtctttaacgtcactgtctgggaaagcaatagtaaaagtatgattatgagtgaatatttatttgctcgactattattattatcttactaagcaaacgcctgggcccagggtcagtctgt

SEQ ID NO: 1267 - DNA, 498 bp, Ctenocephalides felis
  misc_feature (54)..(54): n = unknown
  misc_feature (173)..(173): n = unknown
  misc_feature (317)..(317): n = unknown
  misc_feature (496)..(496): n = unknown
ttttttttttttttttttttttgatttcataaagcttctatatttatatatttnaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgntttatcaaagtgcaagccatttggacaatcataatgttttatttgccatttgttgttaaccaagaaacattgataatattttttacaatctcttcgatcggaaaaaacgttttcacttttgcatgcagtctgacgagaaagattttgggcaaaccattcggtggcgcgcttcacatttnag

SEQ ID NO: 1268 - DNA, 306 bp, Ctenocephalides felis
  misc_feature (33)..(33): n = unknown
  misc_feature (67)..(69): n = unknown
  misc_feature (185)..(185): n = unknown
agagagggtgatagtcatgtagttatttagagngaagagtagtgacaagctggattgggggatctgnnnataataaatttgtattgaaatttttgcagtattaaatctgtgctaaaagtatgagtgaattaataaaataagattttaaaaatttatatagtatcaacacgaatatcaaaaaaagnttttataggtgttctattatacgaagcactcgaaacattaaatctttataaatgaatgttgatcctgtagattacattggagagtagactttggaagtattttatgctcaacaattttagt

SEQ ID NO: 1269 - DNA, 381 bp, Ctenocephalides felis
  misc_feature (48)..(48): n = unknown
  misc_feature (65)..(65): n = unknown
  misc_feature (235)..(235): n = unknown
  misc_feature (238)..(238): n = unknown
  misc_feature (292)..(292): n = unknown
  misc_feature (381)..(381): n = unknown
tttttttttttttttttttgaatgctgtatataacctttatttatggntgcatagatagatgtgngccaaatttaaaaaactattggatatttaattttttttctatattcacattttcattatatttctaatctaatatccccaaatttcaactaagaagttaaatcctttgccagtctgagaagataggagtaaaggtacattttttcagccaactccaccattgacaagagnggnatagcctccttggccatttacatattggtccagggcacgaacacagctaattgngcgattatttctcgatcccactggtggaaatgacacctctctagtagctttcctgaaaaaggttccactcttggattggacttgacagn

SEQ ID NO: 1270 - DNA, 314 bp, Ctenocephalides felis
  misc_feature (4)..(4): n = unknown
  misc_feature (42)..(42): n = unknown
  misc_feature (49)..(49): n = unknown
  misc_feature (51)..(51): n = unknown
  misc_feature (64)..(64): n = unknown
  misc_feature (164)..(164): n = unknown
  misc_feature (223)..(223): n = unknown
  misc_feature (286)..(286): n = unknown
  misc_feature (290)..(290): n = unknown
aatncttggctataagttcgttgcatgttttgcaagtgattngtttatngnatttattgggcgnggcatattttacatgaatcaagagtttgcattacaatcgttaccctgatctgatttgcatcctcgagtaatgacacctttttcaatttttgaatagcagncgtcctttggattcatacaaactttggtcttcgctttcctgcatctttgaaacattcgnttcttagttctggaagtttttgaacgttacaacccgatttctcgcaacacattttttctcggntagncgagtcacaactttctttaaccgt

SEQ ID NO: 1271 - DNA, 500 bp, Ctenocephalides felis
  misc_feature (52)..(52): n = unknown
  misc_feature (198)..(198): n = unknown
  misc_feature (385)..(385): n = unknown
  misc_feature (417)..(417): n = unknown
  misc_feature (420)..(420): n = unknown
  misc_feature (445)..(446): n = unknown
  misc_feature (448)..(448): n = unknown
ttttttttttttcgacaattttacttgtatttatcttaaacatatttacagnatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgngattccataccgcctcacatttgacaataaaatatatgtataatgttaaataggattttaatggaaaaaagccaatttaatactttagcattatgaatatgtatttccaaattattctataacgaatttaacctaaaatacaagaaatacatattcataaatatacatatattttaatcaaaaaggnaacttgtgcaaaaatgaaattcaaatacactnggntttgctaatttaaacggttttaganntntctctttttttggtatggggggttattgcttaatttacaacaatttcttgat

SEQ ID NO: 1272 - DNA, 500 bp, Ctenocephalides felis
  misc_feature (12)..(12): n = unknown
  misc_feature (87)..(87): n = unknown
  misc_feature (214)..(214): n = unknown
  misc_feature (223)..(225): n = unknown
  misc_feature (240)..(240): n = unknown
  misc_feature (280)..(280): n = unknown
ctaaaataaagntacaaaggatttctcaaggtctggtgagacgttccacaaaaattctagaaatcagaacaatgactaaaataaagntacaaaggatttctcaaggtctggtgagacgttccacaaaaattctagaaatcagaacaatggaccggaatatccaaaagacccatttcagatatacttttagcgggcaactgtcgcaaaatctggngaacaatgnnnctttttaaaacaagntggtccttcagtatgtgcgatcacaacataagtagctggntgcatcctcctccttttcccatatttcccagtttttccagctcctggatccactaaaccagttgaattttctggttccacaaaaacaacttcttgaaacaataagtaaaccatccttcgattcagtattttccctagtgcttcagatgctgaagacgattcccatcctgatgtcctggacaattgatcttcatccttggatttggtttcacttctggaaa

SEQ ID NO: 1273 - DNA, 470 bp, Ctenocephalides felis
  misc_feature (34)..(35): n = unknown
  misc_feature (119)..(119): n = unknown
  misc_feature (401)..(401): n = unknown
tgaaatgtgaagacgacgtcaacgaatggtttgnnccaaaatctttctcgtgcggaactgcatgcaaaagtgaaaacgttttttccgatcgaagagattgtaaaaaatattatcaatgnttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtnaggagcacaaacaaaatgtcattaactatagtaatttctgattatttaaaatatataaatatagaagct

SEQ ID NO: 1274 - DNA, 347 bp, Ctenocephalides felis
  misc_feature (11)..(11): n = unknown
  misc_feature (199)..(199): n = unknown
  misc_feature (250)..(250): n = unknown
  misc_feature (338)..(338): n = unknown
caaagcctaancctttggcggtattatggtaaaaattaaaataataccaaaaaatatacctttggaggtaaaatatggttggcaatggatataatcattggatatagaaggctttttatcaagctttttataaatttcgataaccacaagatattggataaaataaaattaccatgtgacccggcaaatgcttggaggnccctgcataaatatatttgaccccattcgctgctgatattgcacactttgntggggattcatccgttagggattaagaaatgggcttgatgtaggtatgggttcccatgccatttgtaatatgcaatccatttaaatgntgagacatt

SEQ ID NO: 1275 - DNA, 424 bp, Ctenocephalides felis
  misc_feature (58)..(58): n = unknown
  misc_feature (94)..(94): n = unknown
  misc_feature (158)..(158): n = unknown
  misc_feature (350)..(350): n = unknown
  misc_feature (385)..(385): n = unknown
  misc_feature (396)..(396): n = unknown
  misc_feature (406)..(406): n = unknown
cgatcggttgcaatttgtcattgcaccaagcataaattgatgggtccggggcataggntataaaagaattgggatttgtgcatttcatgacggngcaatcagcttctgacgatttctttttacacatatttttagaatgatcatatacatagttaggngggcattcgaaaacctgacctttaccatctttgcagaataaagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgnaattggggtttcttgtcagcgcacaacttcaaagnagaacaatcgngacaaaatgntcccaactgcttattagt

SEQ ID NO: 1276 - DNA, 448 bp, Ctenocephalides felis
  misc_feature (11)..(11): n = unknown
  misc_feature (35)..(35): n = unknown
  misc_feature (71)..(72): n = unknown
  misc_feature (80)..(80): n = unknown
  misc_feature (144)..(144): n = unknown
  misc_feature (226)..(226): n = unknown
  misc_feature (373)..(373): n = unknown
  misc_feature (385)..(385): n = unknown
gcagggtgcgntacatatctgaatttttttttggntaaattatttttaatggtaataaatcatagtaaatnngtatttcngggtttgcaaatatggaaactaccatccctatattatatataattggatatattcctgaactgntttatttgaatttattttaaacacaaactttaattatattcaaataatgatggacgtgatttcatatatccctaaactttgnatcagagtttgagagaagcctagccatagtgtatagaaaattatgtgtaggtgtataattaagattgcaggagtcaaatatataaagcattgatacaaattatacattccaattttctgtaaaccgcgttctttggttgattatggnttatatcacaanttatgaatcatgtaaattaattgtaaatttgaaatgtatctccgatgtaaatgtattaacaaa

SEQ ID NO: 1277 - DNA, 393 bp, Ctenocephalides felis
  misc_feature (42)..(42): n = unknown
  misc_feature (55)..(55): n = unknown
  misc_feature (90)..(90): n = unknown
  misc_feature (100)..(100): n = unknown
  misc_feature (121)..(121): n = unknown
  misc_feature (129)..(129): n = unknown
  misc_feature (178)..(178): n = unknown
  misc_feature (301)..(301): n = unknown
  misc_feature (322)..(322): n = unknown
  misc_feature (375)..(375): n = unknown
  misc_feature (378)..(378): n = unknown
tttatttttattaaaaagagacatggggggttcataaagctnctatatttatatnttttaaataatcagaaattactatagttaatgacnttttgtttgngctccttacataaaatacaantttatacnttttaatttttatacatattttttatatttaattgcacagatcatttgngtatttattatattaattgactactttatgataatttgaatcctaattagtctattcaagattgttttcctggtttaagccttacttagcaatctcacttttgcattcttcgccggggggcgngggtatgcatcgcaactccgntttatcaaagtgcaagccatttggacaatcataatgttttatttgccatttgntgntaaccaagaaacatt

SEQ ID NO: 1278 - DNA, 498 bp, Ctenocephalides felis
  misc_feature (60)..(60): n = unknown
  misc_feature (214)..(214): n = unknown
attaaatgcacttataaatatttactggtaaatgtataaaatatgtgaaaagaacctagngctaaattttgttcctgttctagttagattacctcaaaaatgtgttatattaattttccttaacatttgaatgaaatattagctgtttatttattttaatatattcatatgatttttaatatagaacattttgagtaatctagatttaaaatgntattttttgtttctagttttaaatgatcttaaatacggattagtttaagttaaacataaagtgaatcctatataggtgccagtatcaacgtgaaaaagcacactttatctatgtgtaatttagagatgaaataatatttttgtggaagtgggcagttaattttataacagacattcctgtttaattttaacttttatgatttacataaaaattgattgataggaagcattattcaagtcaattattaccattcttaccgtgatgtttgaaaactttagtcataa

SEQ ID NO: 1279 - DNA, 500 bp, Ctenocephalides felis
  misc_feature (51)..(51): n = unknown
  misc_feature (61)..(61): n = unknown
  misc_feature (233)..(233): n = unknown
  misc_feature (276)..(276): n = unknown
  misc_feature (300)..(300): n = unknown
  misc_feature (302)..(302): n = unknown
  misc_feature (335)..(335): n = unknown
  misc_feature (350)..(350): n = unknown
  misc_feature (381)..(381): n = unknown
  misc_feature (419)..(419): n = unknown
  misc_feature (425)..(425): n = unknown
  misc_feature (427)..(427): n = unknown
  misc_feature (436)..(436): n = unknown
  misc_feature (448)..(448): n = unknown
  misc_feature (474)..(474): n = unknown
  misc_feature (488)..(488): n = unknown
ttttttttttttttttttttaagctttccaacatttgtattttattcaaanaaatataaanaaaaatcataattcgacaattttacttgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggntcgactactcagaaagcagccacccgtgattccataccgcctnacatttgacaataaaatatatgtntnatgttaaataggattttaatggaaaaaagccantttaatactttagcnttatgaatatgtatttccaaattattctatnacgaatttaacctaaaatacaagaaatacatattcatnaatatncntatattttnatacaaaaaggngacttgtgccaaaatgaaaatcaaanacacttgggtttgntaaattaaaatg

SEQ ID NO: 1280 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataagacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgtatctttttaata

SEQ ID NO: 1281 - DNA, 415 bp, Ctenocephalides felis
  misc_feature (18)..(20): n = unknown
  misc_feature (44)..(44): n = unknown
  misc_feature (51)..(51): n = unknown
  misc_feature (55)..(55): n = unknown
  misc_feature (133)..(133): n = unknown
  misc_feature (216)..(216): n = unknown
  misc_feature (249)..(249): n = unknown
  misc_feature (402)..(402): n = unknown
  misc_feature (407)..(407): n = unknown
tttttttttttttttttnnngttaaaaattggatttattggggntcatacngggnattatttatttacactaaaaacaatttatatttgaattttcagacatagtatgatgaatttgagcttatgttctctgntattggtcacattgatatatttatttatatacataatttatgatattacagacattcgaatattgctttaataaataaaatcnttatacataattgctaagtaataatacactatnggcaatatttcaataataagtttaggccaaacatttaaattttgactgaatctgaataactttaataatacagtaacaaacaatcaaaataattaattttgcagtacagttataatgaaacaagacaatggggaactttatattttatattgntatgnatatacac

SEQ ID NO: 1282 - DNA, 254 bp, Ctenocephalides felis
  misc_feature (23)..(23): n = unknown
  misc_feature (133)..(133): n = unknown
ccgggcaggtactaaaataaagntacaaaggatttctcaaggtctggtgagacgttccacaaaaattctagaaatcagaacaatgctttcaaaatacaaatacacgtcctacaatatcaccattcaacacctncaacaattttactatatcatttactcctcaaaattcgtcctagtaggcttataaacaccgacatccttgtcctccgaatggtagcccaaggaggccaattcgtccataacctcaacattgt

SEQ ID NO: 1283 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataagacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgttcttttaataaa

SEQ ID NO: 1284 - DNA, 500 bp, Ctenocephalides felis
  misc_feature (51)..(51): n = unknown
  misc_feature (209)..(209): n = unknown
  misc_feature (406)..(406): n = unknown
  misc_feature (409)..(409): n = unknown
  misc_feature (498)..(498): n = unknown
ttttttttttgcaaaggaacggcccaaacgatttatttttattaaaaaganacatgtaaggttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgntgntaaccaagaaacattgataatattttttacaatctcttcgatcggaaaaaacgttttcacttttgcatgcagttctgcacgagaaagantt

SEQ ID NO: 1285 - DNA, 111 bp, Ctenocephalides felis
  misc_feature (12)..(12): n = unknown
  misc_feature (90)..(91): n = unknown
atattagattgntatagtgttataatgagttttaaaatgtatcacttttgtaaggtttacattggttttatataaatgtttataagcgtnnaaaaaaaaaaaaaaaaaaaa

SEQ ID NO: 1286 - DNA, 429 bp, Ctenocephalides felis
  misc_feature (64)..(64): n = unknown
  misc_feature (403)..(403): n = unknown
  misc_feature (418)..(418): n = unknown
aataattttaaaattaatctttcaagttattctgaatcgtttgacagaaaaaaatttaaaaacntgttttcttgttttactaaaaaatgtcgttattttttcaatgaatattgaaagtgtttccaaaaatttctaagttaatttaattaattttttaattatttttattcagatgttgtcacacaaaactatttatatatcatcatatttattttgtatatattttctatgataaacctgtaaattatttataaaaagaagccaaaaaaaagaatttgtagtgaaaaaatatttcaaatttgaaacacaaactgaatgttctgaatgttaattatatgtgattaaaataataaacatttattgaaatattaaaaaaaaacaatacaaattatggtagattggnaaaaaaaaaaaaaanaaaaaaaaaaa

SEQ ID NO: 1287 - DNA, 498 bp, Ctenocephalides felis
  misc_feature (373)..(373): n = unknown
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacanttttataagctgtttggataaattaattttgaataaatccataatcatagaatatgttaagtagcaaattaaaatatggaccacaaaccacaaaatgtatacgaaatataacttatatgatatat

SEQ ID NO: 1288 - DNA, 336 bp, Ctenocephalides felis
caagaacactatacgtgcgaaaactgagaataaagctcccgctaaaaatactgttctactgctgactttaacacaagcagtcattcctgccaaaaacatccttgatgacaaatctgcagctgctgcggcagatacacaaattgctgtatcagtctttgaccagcctaatgcaaacagatacattgtttgaatagcagaaaatgctatgtcggagtatagtgcaaatgtcactccaataaccatatttacataaatccagtcttttaacaaagtcaaatccaaaaagtcaacgataacttgcaattttcccctagatttcttctctaccggtgcagt

SEQ ID NO: 1289 - DNA, 500 bp, Ctenocephalides felis
  misc_feature (392)..(392): n = unknown
  misc_feature (420)..(420): n = unknown
  misc_feature (442)..(442): n = unknown
ctgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataagacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgnttttatgtaaggagcacaaacaaaatgncattaactatagtaatttctgnttatttaaaatatataaatatagaagctttatgaaattcatgtttctttttaataaaa

SEQ ID NO: 1290 - DNA, 386 bp, Ctenocephalides felis; identical to SEQ ID NO: 468

SEQ ID NO: 1291 - DNA, 255 bp, Ctenocephalides felis
  misc_feature (57)..(58): n = unknown
cggcgacaaaacacttgaagataaattctttgaacatgaggttcatctcaatgtgtnngctttcttgcaacaattccatttcggagtattttactcttatttgaaactcaaggaacaagagtgccgtaacattgtttggataagtgagtgcgttgctcaaaagcacaggaccaagattgacaactacattccaatattttaattaatttgttgttaattttgataacgttgattttatccagatgtttgttgtgt

SEQ ID NO: 1292 - DNA, 498 bp, Ctenocephalides felis
  misc_feature (475)..(475): n = unknown
catcataccagccgaaagcgcaaaaccaaatttggtatcagatataggagttgataataattgccaatcaattattaacagcgatgctgttaacagcaacgaagttgtggaagaacctattgtgaatggagaaactgtgaacaatgctaaagcaatagaagaattagataaatgcaccaaggaaattaacgaaatacttcgtgagttagacgatacgccggcaacaaatttggaagttcagaatgacgacactaacaacaatcaaatgcccgcttggtcctcattttacagaagcgtaacgactgtctctgatggaaaacatcgtgcagagatcaataatgtccaattgaattctagtcctgagaatagtcttgaaattgatctaaatgcaagcaccttaaagaactaaagaaatagacttcactttaatttaaaggtttctaacaatcctattattatcttatagtatatatgntacagaaacatcaattttatata

SEQ ID NO: 1293 - DNA, 498 bp, Ctenocephalides felis
  misc_feature (48)..(48): n = unknown
  misc_feature (96)..(96): n = unknown
ctagtgagtgtgttatatgaaattgctattgcatattacatacaagcntaataaaggggtatggtgatttatttcatttaaaggcaatgtatcggnttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgttttaagtataaatcttattagggcacaatatgaaaataaaaataagaactttatacaaaagctttttttatacaatatgcttcttgcgctattaagttaagaaattttatttatgcttgtaaaaaaacaataaatgctttatttatca

SEQ ID NO: 1294 - DNA, 258 bp, Ctenocephalides felis
  misc_feature (12)..(12): n = unknown
  misc_feature (83)..(83): n = unknown
  misc_feature (92)..(92): n = unknown
ttccagcgggcngcccggcagggacagggcaacagcatttaaccatgcttatgctgataccggtctattctgcattcatgccngcgcacctncaacacatatacggggggtaacagaagtgctctgcagagaactagttgccatgtctacagttccaggggctcaagaactaaggagagcaaaaacacaacttcaatcaatgttattgatgaatttggaagctcgtcctgtggtatttgaagatataggtagacaagt

SEQ ID NO: 1295 - DNA, 362 bp, Ctenocephalides felis
  misc_feature (28)..(28): n = unknown
  misc_feature (30)..(30): n = unknown
  misc_feature (66)..(67): n = unknown
  misc_feature (69)..(69): n = unknown
  misc_feature (157)..(157): n = unknown
  misc_feature (246)..(246): n = unknown
  misc_feature (286)..(286): n = unknown
  misc_feature (346)..(346): n = unknown
  misc_feature (350)..(351): n = unknown
  misc_feature (357)..(357): n = unknown
tgataaattgcctgcaagaatgagtttnanggaacgaaaagaatcggccaaatgcatgcaaaaggnngnattaaatatacaactagcagcagccagagtttcaactgatgttggcattaaagtaggagaagccctcaggaatgtcgtggaacttcgnttagatttgggaaaatgttcttcagacaatttgaataaatgggaatccagattggaagaaattaatgatgttgtggaaaattgcatcgngtgaaattgtaacttgaaataatttttcttaactattagntttatagatgaacaaatacataatctaataaaccagcaagtgaactcaaaaaaaaaaaanttannaaaaanaaaaa

SEQ ID NO: 1296 - DNA, 148 bp, Ctenocephalides felis
atgaaattatgtgttttgaaatttttccgattttgtaaataagacatgcttttgttttgatattttaaatgtgttcattgggattactggctttttttacaaactcatatgcttgatacgcatatacatacacataatttgcacatgt

SEQ ID NO: 1297 - DNA, 203 bp, Ctenocephalides felis
tatttttactaacagttgcatttatttgttaaataataaattttaattaaattaataaaaaaaaatctacgtcacaaattcgatgtcgatacaacgttgtcgcgatatcgcatgtttagtaactttgaaacttttataacttttaaacggtttgtttaatttgagtgaaatatttggcaaatttcttggaaattaaataatgt

SEQ ID NO: 1298 - DNA, 203 bp, Ctenocephalides felis; identical to SEQ ID NO: 1297

SEQ ID NO: 1299 - DNA, 389 bp, Ctenocephalides felis
  misc_feature (70)..(70): n = unknown
ggaccgcaagtccaatccaagagtggaaactttttcaggaaagctctagagaggtgtcatttccaccagngggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatacagcattcaaaaaaaaaaaaaaaaaaaaaaaaaaa

SEQ ID NO: 1300 - DNA, 192 bp, Ctenocephalides felis
catcgccatctaatgagtttgatcccaaatagacggattttaaaatgccagcgtttaggcaatgtgcagctgttacaatccaacgtttgttcaagatggaaccaccacagaaatgctccaggttctgatctctcaatgatacttggtacgcgaacctatgcaaactggaattaaagctgttgattctcttgt

SEQ ID NO: 1301 - DNA, 500 bp, Ctenocephalides felis
  misc_feature (25)..(25): n = unknown
  misc_feature (28)..(28): n = unknown
  misc_feature (33)..(33): n = unknown
  misc_feature (53)..(53): n = unknown
  misc_feature (68)..(68): n = unknown
  misc_feature (92)..(92): n = unknown
  misc_feature (163)..(163): n = unknown
  misc_feature (214)..(214): n = unknown
  misc_feature (240)..(240): n = unknown
  misc_feature (322)..(322): n = unknown
  misc_feature (386)..(386): n = unknown
  misc_feature (393)..(393): n = unknown
  misc_feature (396)..(396): n = unknown
  misc_feature (405)..(405): n = unknown
  misc_feature (486)..(486): n = unknown
ttttttttttttttttttttttttnaangctgnatataacctttatttatggntgcatagatagatgngtgccaaatttaaaatactattgnatatttaattttttttctatattcacattttcattatatttctaatctaatatccccaaatttcaactaanaagttaaatcctttgccagtctgagaagataggagtaaagttacatttttncagccaactccaccattgacaagagnggcatagcctccttggccatttacatattggtccagggcacgaacacagctaattgtgcgattatttctcgatcccactggnggaaatgacacctctctagtagctttcctgaaaaagtttccactcttggattggacttgacggncctcggncgngaccacgtngagcgggcgccgggcaggtcattgaattgatgtaacatttaatgaaagcagttcagtagaccgatcaggccactttgagcnttcataaaatgcct

SEQ ID NO: 1302 - DNA, 386 bp, Ctenocephalides felis
  misc_feature (364)..(364): n = unknown
  misc_feature (384)..(385): n = unknown
tgtcaagtccaatccaagagtggaaactttttcaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaattaaatatacaatagtattttaaatttggcacacatctatctatgcatccataaataaaggttatatacagcattcaaaanaaaaaaaaaaaaaaaaaaanna

SEQ ID NO: 1303 - DNA, 455 bp, Ctenocephalides felis
  misc_feature (24)..(24): n = unknown
  misc_feature (36)..(36): n = unknown
  misc_feature (41)..(41): n = unknown
  misc_feature (43)..(43): n = unknown
  misc_feature (49)..(49): n = unknown
  misc_feature (208)..(209): n = unknown
  misc_feature (238)..(238): n = unknown
  misc_feature (258)..(258): n = unknown
  misc_feature (338)..(338): n = unknown
  misc_feature (369)..(369): n = unknown
ttttttttttttttttttccattnattatataagtnatatntncgtatncattttgtagttccatatttcaatttgctacttaacatattttataattatggatttattcaaaattaatttaatccaagagcttatgaaattgtatttatcttttatccattcagcaataaaaggtaataaaaaatacacatagaaatcttttcaggnntggccatttatacatttttttattacagncatcaaaaaaatagtatttntatgttatttttcaaaatctatacattgataagggttagaaatttgttcggttaattttcaggctgaggttgctactgtngtaatagaacaattttaataatctaaaattngattaatctattacatttaatcattcaatagtaaatttccttttggaattcgaatggtgccattacgggaaacaaagtctcctcgt

SEQ ID NO: 1304 - DNA, 386 bp, Ctenocephalides felis
  misc_feature (65)..(65): n = unknown
cctacacaactcagggcaatggcagtatgtatatctttaatgatgggtcgattaggaagtgttgntggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcgattacaaagaaaattcagaagttgctactgaatcattttctaaaacatcgacatgaaaattaataactctttattgttattagattcgatgtaagatatatgt

SEQ ID NO: 1305 - DNA, 498 bp, Ctenocephalides felis
  misc_feature (3)..(3): n = unknown
  misc_feature (9)..(9): n = unknown
  misc_feature (52)..(52): n = unknown
  misc_feature (63)..(63): n = unknown
  misc_feature (88)..(88): n = unknown
  misc_feature (102)..(102): n = unknown
  misc_feature (120)..(120): n = unknown
  misc_feature (128)..(128): n = unknown
  misc_feature (162)..(162): n = unknown
  misc_feature (193)..(193): n = unknown
  misc_feature (343)..(343): n = unknown
  misc_feature (392)..(392): n = unknown
  misc_feature (406)..(406): n = unknown
  misc_feature (444)..(444): n = unknown
tgnaaatgngaggacgacgtcaacgaatggtttgacccaaaatctttctcgngcagaactggntgcaaaagtgaaaacgttttttccnatcgaagagattgnaaaaaatattatcaatgnttcttggntaacaacaaatggcaaataaaacattatgattgnccaaatggcttgcactttgataaaacggagntgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgngcaattaaatataaaaaatatgtataaaaattaaaatgtataaaattgnattttgtgtaaggngcacaaacaaaatggcattaactatagtaatttctgantatttaaaatatataaatatagaagctttatgaaattaaagaaaaaaaaaaaaa

SEQ ID NO: 1306 - DNA, 322 bp, Ctenocephalides felis
  misc_feature (58)..(58): n = unknown
  misc_feature (61)..(61): n = unknown
aaaaaatttgtagtattaaataaaaaaaagccatattaatttttcttgttacataagntgnaaatatattacatcactcgtaaggcttgtcatcgttaaagtaaacatataatttattattcaccaatcagttcatttatcataacaaagacatatataataagattttagtttaattataaaaaatgctaaaaaatatttttaacaaaaacgcaatagaattatttatgaattattacttaacatttcaaaaggtgcatatttggtgataaataaacaaatgcattagagataagcaaatatttatgaaaagtatgaacag

SEQ ID NO: 1307 - DNA, 499 bp, Ctenocephalides felis
  misc_feature (42)..(42): n = unknown
  misc_feature (49)..(49): n = unknown
ttttttttttttttttttttttgtaactttatattttatatngctatgnatatacacaatatgatcaaattttaacagttaaattgaatttattagattatataaaactgaaaattatcatggaatgtaatttaaaatcatacagaaaaaaacaaatataataataaaatttgataatatttcaacaacttgtagctagtacggcagaatactgtttcacaacaacatactttcattttaacaatagaatcattattttataagtatctacaatttctttaaacattaaaacatgtcttcatgttttccttacattaaggatgtggttagtaccagacatcccaaaaactgatttaatattctttacatggagaagacatcatataaagggaaataaaatatggtattgatggaaactttagtaagatttttaatgacgagaatcacgtgggtaaaactcggcgagggtggaagcgggtattctcttcaacatctcctt

SEQ ID NO: 1308 - DNA, 421 bp, Ctenocephalides felis
  misc_feature (8)..(8): n = unknown
  misc_feature (94)..(94): n = unknown
caatcggntgcaacttgtcattgcaccaagcataaattgatgggtccggtgcataggttataaaagaattgggatttgtgcatttcatgacggngcaatcagcttctgacgatttctttttacacatatttttagaatgatcatatacatagttaggtgggcattcgaaaacctgacctttaccatctttgcagaataagtatcttgtgcagtctttcggatatggctgatatcctacaaccgcgcatgtagtttctgccgcttacagttttcccaggttttgatgagcacatatcatctacacaaaatggagcatcggaatttgagtctctgcaattgattgttgtaattggggtttcttgtcagcgcacaacttcaaagtagaacaatcgtgacaaaatgttcccaactgcttattagt

SEQ ID NO: 1309 - DNA, 328 bp, Ctenocephalides felis
  misc_feature (64)..(64): n = unknown
taaaatgttaaatatttataatatatttctgataaataagggtcattaaacatcatttgcatgngtttgaaaaaacaccacaacattgtttataggaagctttgcctttgttactttagttttcaaaatttgttcaaggccctcttctccctttccttcgtaagcttttttaagtatctcataagtcaatcctttttttgacattttgcgaagtgtttcaatggttacgactgatttaagaggtgccaataatattagctcatcagccattttttgcatttccaaaatatcatcgataattctgagtttgtttgaaaggtgcttcagt

SEQ ID NO: 1310 - DNA, 495 bp, Ctenocephalides felis
  misc_feature (65)..(65): n = unknown
aatgtgaagacgaccgtcaaccgaatggtttgacccaaaatctttctcgtgcagaactgcatgcnaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattcatgtatctttttaata

SEQ ID NO: 1311 - DNA, 386 bp, Ctenocephalides felis
  misc_feature (55)..(55): n = unknown
  misc_feature (57)..(57): n = unknown
  misc_feature (363)..(363): n = unknown
atatatcttacatcgaatctaataacaataaagagttattaattttcatgtcgangntttagaaaatgattcagtagcaacttccgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgncattgccctgagttgtgtagggt

SEQ ID NO: 1312 - DNA, 328 bp, Ctenocephalides felis
  misc_feature (57)..(57): n = unknown
ctgcaaatccattctgtttttacaagtataagtggcggacagagcagtttgtccagntctgaatcagcaaatgagacggctgctgcaatcctggccatggtgcctcaggtgctccacaagtacctggctgtcaaaccaaagaacgccacaggcggacaaaatacaacgattgggcgaatgacgatcaatcctcagctgtcgatgatagaaaggcacgaagcggctttgtccgaaatttcgaaacaaattcgatattataacacgaaacaaacagtaatcaatgaagaaatatttggtccattgcagaatgattccgtcgtcattgttg

SEQ ID NO: 1313 - DNA, 212 bp, Ctenocephalides felis
  misc_feature (3)..(4): n = unknown
  misc_feature (38)..(38): n = unknown
  misc_feature (66)..(66): n = unknown
gcnnggtttcaaatgtccgtcaccatcgagattttatncaaatataaatgattgtcagggctattngtattgtgacgaaaatagtataggaacccaatattattgccccgcaaattttgcatatgatccgttacgtcataattgcggacctatggctctgggcacaaaatgctatacagttacatgtcctgcacagcctaaggtgcttccgt

SEQ ID NO: 1314 - DNA, 165 bp, Ctenocephalides felis
  misc_feature (58)..(58): n = unknown
cgccacccaagtcatatacagcaataattttatcctcagtcttatccattccgtaagncaaagcagctgcagtcggttcattaataactctcaaaacattgagtcctgagatttgtccggcatcctttgtagcctgtctttgtgaatcattaaaataaagcaggt

SEQ ID NO: 1315 - DNA, 412 bp, Ctenocephalides felis
  misc_feature (110)..(110): n = unknown
  misc_feature (165)..(165): n = unknown
  misc_feature (190)..(191): n = unknown
  misc_feature (250)..(250): n = unknown
cgttatttatattatattgcttatacagaaagcactgttgtatgaaaagtatctgaaatcaacacatctcatgtaaggttactttattgtaaaagttattttatatgtantttttaataacattaaaattattttgttctttctgttagatgaattgtgtgttanatcttgtgctgtgatttacatacannttaatacagattgaaatgcaatctataaaagcattatttcaataatcattatatagtanttttgattttgactatttgcagataaattcattacattttaaaatgtttactttattaagctatacaaaccttgaactttacactttgtatttctagaacataagtattaaataaattgttaaaaatatttgtggctagattttcctattgctaattgtgtg

SEQ ID NO: 1316 - DNA, 129 bp, Ctenocephalides felis
  misc_feature (39)..(39): n = unknown
  misc_feature (76)..(76): n = unknown
  misc_feature (85)..(85): n = unknown
cggggagggacctgtatttttcttctggtcattatgctnaattgcaagaaccttgttaatgctgcgggcaccaacnacgcgcctncaatgaagatattccgtagccgaagagttcttctcagtgatggt

SEQ ID NO: 1317 - DNA, 276 bp, Ctenocephalides felis
  misc_feature (58)..(58): n = unknown
ttgttgtattccatgcccactgaatccggttgctatatatgtattattgggatatggnggcaatcctataatgccattttcatcaaaggtattgtattcgtaataaccagcccatgcacttttaactttaattgcttcaaaacatggaacacgatgtgctaaatgtggccaaacgttttgttcaaaataatccatatctacatctaagttatcgactggcggttctttgtcaggatctggtgaacgaccacagatatatctgccacctaatccatc

SEQ ID NO: 1318 - DNA, 500 bp, Ctenocephalides felis
  misc_feature (47)..(48): n = unknown
  misc_feature (57)..(57): n = unknown
  misc_feature (59)..(59): n = unknown
  misc_feature (182)..(182): n = unknown
  misc_feature (240)..(240): n = unknown
  misc_feature (420)..(420): n = unknown
  misc_feature (496)..(496): n = unknown
ttttttttttttttttttgttaaaatatttttcttttattaaattgnngggcaaccngngataatacctctgacataaaattgtaaattattctaacaaaagtttggagttatggcatgaatgcacacttaacactaccagcaattttgtctcagcataaaatttcataaatagaggagctnaaaaagaacaaaataaccataatatagtcattaacattaacaaaaatataatattatntattaaaaagtaaagcaaatataatctttgaaaaatattcttacacacactcacatatatatgcctttgcatagactccgaatggagtcgagatcaaaataataacatggagcatcatacacactcaaagaacaaatagtataataataatatgcgtgttaaatatcattcattcatttnttttttttttttattgccgattattcgagagccaaataataaaaattaaattattcaatattaaaatataaaatgnaaat

SEQ ID NO: 1319 - DNA, 340 bp, Ctenocephalides felis
  misc_feature (54)..(54): n = unknown
  misc_feature (63)..(63): n = unknown
  misc_feature (147)..(147): n = unknown
  misc_feature (151)..(151): n = unknown
  misc_feature (181)..(181): n = unknown
  misc_feature (296)..(296): n = unknown
  misc_feature (311)..(311): n = unknown
  misc_feature (315)..(315): n = unknown
aatggcattatatgcaaattataggctgagcctttataaatctgtgaatgaacnacaccactntatcttctaacctaaagtgtaattttgttttacagaatttctttaataggtaatatttttaattgcagtgtatcatattatagnttgnaggtgttatattttatttgtaaattggtgntcatatttctcaaacgattgtttatgtattacacagtattaaaataaaccttggatgcaataattgttataacaacattgttgttagtaataaaattttatcaatggattattanaaaaaaaaaaaaaangaanaattggaaaaataaaaaaaaaaaaa

SEQ ID NO: 1320 - DNA, 310 bp, Ctenocephalides felis
  misc_feature (39)..(39): n = unknown
  misc_feature (203)..(203): n = unknown
cgggacgcaatttcaagcaatttttacttcaatactcancatattatttttgagccaaatggtcacatctgccagcatacaggattgggttcatgatgaattgagtcaacaaccttcattgaacctggttttaccacaaagaccagaacatatattaacagattgtatgcaccgtcacatcaaaagacggtgacttctttttnaaaagcaatggtgtcgaagattcttcagcagaagttccagtttgtggtctctatttgatcacagaagccaacatgagggttgagttgacaattaggcattttgatgt

SEQ ID NO: 1321 - DNA, 157 bp, Ctenocephalides felis
acgaggagttaataaagatattaatgtcaacatagtagatacttgtcagaaatgcagaggttccaggtgtgagcctggcacaaagcctgtcaaatgtacacattgtaacggaacagggatggagactttatccacagggccttttgttatcagaagt

SEQ ID NO: 1322 - DNA, 328 bp, Ctenocephalides felis
  misc_feature (56)..(56): n = unknown
  misc_feature (64)..(64): n = unknown
taaaatgttaaatatttataatatatttctgataaataagggtcattaaacatcanttgcatgnttttgaaaaaacaccacaacattgtttatagtaagctttgcctttgttactttagttttcaaaatttgttcaaggccctcttctccctttccttcgtaagcttttttaagtatctcataagtcaatcctttttttgacattttgcgaagtgtttcaatggttacgactgatttaagaggtgccaataatattagctcatcagccattttttgcatttccaaaatatcatcgataattctgagtttgtttgaaagttgcttcagt

SEQ ID NO: 1323 - DNA, 498 bp, Ctenocephalides felis
  misc_feature (206)..(206): n = unknown
  misc_feature (325)..(325): n = unknown
  misc_feature (406)..(406): n = unknown
ttttttttttttttttttttttgtaactttatattttatattgctatgggatatacacaatatgatcaaattttaacagttaaattgaatttattagattatataaaactgaaaattatcatggaatgtaatttaaaatcatacagaaaaaaacaaatataataataaaatttgataatatttcaacaacttgtagctagtacggnagaatactgtttcacaacaacatactttcattttaacaatagaatcattattttataagtatctacaatttctttaaacattaaaacatgtcttcatgttttccttacattaaggatgngggtagtaccagacatcccaaaaactgatttaatattctttacatggagaagacatcatataaagggaaataaaatatggnttgatggaaactttagtaagatttttaatgacgagaatcacgtgggtaaaactcggcgagggtggaagcgggtttctcttcacatctccttg

SEQ ID NO: 1324 - DNA, 341 bp, Ctenocephalides felis
  misc_feature (29)..(29): n = unknown
  misc_feature (55)..(55): n = unknown
  misc_feature (63)..(63): n = unknown
  misc_feature (79)..(79): n = unknown
  misc_feature (125)..(125): n = unknown
  misc_feature (130)..(130): n = unknown
  misc_feature (140)..(140): n = unknown
  misc_feature (146)..(146): n = unknown
  misc_feature (150)..(150): n = unknown
  misc_feature (170)..(171): n = unknown
  misc_feature (179)..(179): n = unknown
  misc_feature (200)..(200): n = unknown
  misc_feature (218)..(218): n = unknown
  misc_feature (228)..(228): n = unknown
  misc_feature (333)..(333): n = unknown
ttttttttttttttttttttttttttttngcaaaggaacggcccaaacgattggntttttatngaaaagatacatgtantttcataaagctcctatatttatatattttaaataatcagaaattnctatngttaatgacnttttgnttgngctccttacataaaatacanntttatacnttttaatttttatacatattntttatattaattgcacanatcattctgngtatttattatattaattgactactttatgataatttgaatcctaattagtctattcaagattgttttcctggtttaagccttacttagcaatctcacttttgcnttcttcgc

SEQ ID NO: 1325 - DNA, 500 bp, Ctenocephalides felis
  misc_feature (51)..(51): n = unknown
  misc_feature (59)..(59): n = unknown
  misc_feature (64)..(64): n = unknown
  misc_feature (106)..(106): n = unknown
  misc_feature (123)..(123): n = unknown
  misc_feature (129)..(129): n = unknown
  misc_feature (154)..(154): n = unknown
  misc_feature (166)..(166): n = unknown
  misc_feature (248)..(248): n = unknown
  misc_feature (271)..(271): n = unknown
  misc_feature (299)..(299): n = unknown
  misc_feature (367)..(367): n = unknown
  misc_feature (371)..(371): n = unknown
  misc_feature (414)..(414): n = unknown
  misc_feature (455)..(455): n = unknown
  misc_feature (478)..(478): n = unknown
ttttttttttttttttttttttttttatgtacaataaatataattttaggntataaganacatntgtataacaatacaaattataactatttaacagtcttcttgngataatttcttgacggncgtatntgtagactttgatacaccttttttnggtaagctccanaacacctgatccctgccgaatacgtgagcttcagttagcgtttccggtaacttttggtgtaaagtttccggcaagaacattncggaagtcgcgcccaccatcatnattacggaaagtacagcgtacgggtatntggcgtcatatgtggttcccaagtatacaatgtatgggcctaatactcctaatgcatttgaaactatngttncaatggaaattcctgtctgcctcacacaggttggatatgtttncattgcttgcagattcacacataaaacgtgatgcttatgtnaaattttattccacggttacagngataccaaattctggagggatt

SEQ ID NO: 1326 - DNA, 305 bp, Ctenocephalides felis
  misc_feature (27)..(27): n = unknown
  misc_feature (50)..(50): n = unknown
  misc_feature (62)..(62): n = unknown
  misc_feature (82)..(82): n = unknown
  misc_feature (216)..(216): n = unknown
  misc_feature (227)..(227): n = unknown
  misc_feature (241)..(241): n = unknown
  misc_feature (255)..(255): n = unknown
  misc_feature (257)..(257): n = unknown
ttttttccttttttttttttttttttntatattcacattttcattatatngggtaatctggnatccccaaatttcaactaanaagttaaatcctttgccagtctgagaagataggagtaaagttacatttttccagccaactccaccattgacaagagtggcatagcctccttgaccatttacatattggtccagggcacgaacacagctaattgngcgattatttnttgaacccactggnggaaatgacacctntntagtaactttcctgaaaaagcttccacttttggattggacttgacggt

SEQ ID NO: 1327 - DNA, 480 bp, Ctenocephalides felis
  misc_feature (61)..(61): n = unknown
  misc_feature (475)..(475): n = unknown
tgaaatgtgaagacgacgtcaacgaatggtttgacccaaaatctttctcgtgcagaactgngtgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgnacttt

SEQ ID NO: 1328 - DNA, 500 bp, Ctenocephalides felis
  misc_feature (61)..(61): n = unknown
  misc_feature (447)..(447): n = unknown
  misc_feature (464)..(464): n = unknown
  misc_feature (470)..(470): n = unknown
tttttttcttttttttttttcgacaattttacttgtatttatcttaaacatatttacaggnatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatacatattcataaatatacatatattttaatacaaaaaggtaacttgtgcaaaaatgaaattcaaatcacttggttttgctaatttaaattgnttttagatttttctctnttttgntatggtggttattgcttaatttacaacaat

SEQ ID NO: 1329 - DNA, 290 bp, Ctenocephalides felis
  misc_feature (194)..(194): n = unknown
atttttttataaataaacgtgatttgcctagcagtcttataaaatacagttcaacaattccttatacttatcagtgctttctaaaataacatacataatttaaatcaaaattaaatacgagtaacaaaagtagtaaacaaatagaattagttctaatttacttatacctaaactaattcagataagttgagtanatcgccattttcttttaatttaataaaaaaaattatgatgtattaaatatttcacatattgtttttaaatgtttcagatatcttatacaagtttgt

SEQ ID NO: 1330 - DNA, 372 bp, Ctenocephalides felis
  misc_feature (63)..(63): n = unknown
  misc_feature (214)..(214): n = unknown
  misc_feature (221)..(221): n = unknown
  misc_feature (260)..(260): n = unknown
  misc_feature (268)..(268): n = unknown
  misc_feature (314)..(314): n = unknown
atggcatcaccgccaaaattttagcgcacaaacgcaaatcatctgtgctatcatcaaactctngttcaggaattatatcatttacatccaaattgccttcgtaatgttttctacaaatgctgctctgtagaaccttttcaattcctcatagtgctggtctctgaaacttctggatgttgtctgatatagaagatgattgaaatccaaagctggnggattgnaggtgcatctttggaaatctaccaagatgcattgttcangtagaccngttgaattatatttgaacatcaaattgtgattgcgcgtatcgcggnggcataccacattcttataaatgcgcgatggtttaccatagaccatgccaatctcagg

SEQ ID NO: 1331 - DNA, 270 bp, Ctenocephalides felis
  misc_feature (46)..(46): n = unknown
  misc_feature (49)..(49): n = unknown
agatctactaatgccgcgtttaccactgtcacagcaattccgcaanggnagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1332 - DNA, 415 bp, Ctenocephalides felis
  misc_feature (49)..(49): n = unknown
  misc_feature (69)..(69): n = unknown
  misc_feature (71)..(71): n = unknown
  misc_feature (239)..(239): n = unknown
  misc_feature (356)..(356): n = unknown
  misc_feature (385)..(385): n = unknown
cgttatttatattatattgtttatacagaaagcactgttgtatgagggngtatctgaaatcaacacatntnatgtaaggttactttattgtaaaagttattttatatgtaatttttaataacattaaaattattttgttctttctgttagatgaattgtgtgttagatcttgtgctgtgatttacatacaatttaatacagattgaaatgcaatctataaaagcattatttcaataatnattatatagtaattttgattttgactatttgcagataaattcattacattttaaaatgtttactttattaagctatacaaaccttgaactttacactttgtatttctagaacataangtattaaataaattgttaaaaatatttgnggctagattttcctattgctaattgtgtgt

SEQ ID NO: 1333 - skipped

SEQ ID NO: 1334 - DNA, 313 bp, Ctenocephalides felis
aattcttggctataagttcgttgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 1335 - DNA, 385 bp, Ctenocephalides felis
  misc_feature (48)..(48): n = unknown
  misc_feature (329)..(329): n = unknown
atatatcttacatcgaatctaataacaataaagagttattaattttcntgtcgatgttttagaaaatgattcagtagcaacttctgaattttctttgtaatcgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttnctaatcgacccatcattaaagatatacatactgccattgcctgagttgtgtagggt

SEQ ID NO: 1336 - DNA, 498 bp, Ctenocephalides felis
  misc_feature (57)..(57): n = unknown
  misc_feature (409)..(409): n = unknown
aaatacaaggggttgtatgaaaccaactgatgactgtgatgatatgaaatgccaggngtgcaaaggtaacctttgtaatgtcgatgttttcccaagaaatcgcagggtttgcaacgctaaagatgatgccaaggaagtttgtctcaagccacaagatacttgtttgagtattttaaatgcacaaggtgatgccataaaattagggtgcaccagcaacctgttcaagaaccagaatctgaaaaaaatgtgcgagaaaaaaccagaacgttgcccaacttgtgacaaaaacgaatgcaatggtgatgccaaaaaacacgaatgtgtttcttgtgatgaaaatgatgaaaattgcttgacgaccctgaaaaagtcgagacgaagaccaaatgcatgggcaaatgctacttanatattgacggagataaagtgaagagaggctgcccgcacctacaaatgcgataaggaaacttgtctggaatgcgaggaagagattgccga

SEQ ID NO: 1337 - DNA, 379 bp, Ctenocephalides felis
  misc_feature (18)..(18): n = unknown
  misc_feature (47)..(47): n = unknown
  misc_feature (49)..(49): n = unknown
  misc_feature (56)..(57): n = unknown
tttgcagactgtactttntttagtggtgcactgtagatatccacttngntcagcgnncacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaacattctaataaatatgttacccagc

SEQ ID NO: 1338 - DNA, 388 bp, Ctenocephalides felis
cgtgtcgacgatttgcaagtagttgggaatttggccgccattagataagtatccccatccagccagagtggatactgctccaattggtgtatcatagcttgccagaccaactggtttgacatagtttgtgtatacaatatttgatgtagtttttagtaaagcgatgttattgtggtatgtgttctggttaaattggttatgaacgattatttgggcaactttgtatcctactccgccagcattcaaagtgttggttccaacgacgagaagaatatcatttggatatttatttaacacgcaagtagcagcagtaagaatccaacgattgctgatgatggcaccaccacagaagtgtccttggttggttctcaaagacaccataaaaggt

SEQ ID NO: 1339 - DNA, 498 bp, Ctenocephalides felis
  misc_feature (54)..(54): n = unknown
  misc_feature (62)..(63): n = unknown
  misc_feature (421)..(421): n = unknown
tgaaatgtgaagacgaccgtcaacgaatggtttgacccaaaatctttctcgtgnggaactgnntgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaagaagcacaaacaaaatgncattaactatagtaatttctgattatttaaaatatataaatatagaagctttatgaaattaaaaaaaaaaaaaaaaa

SEQ ID NO: 1340 - DNA, 273 bp, Ctenocephalides felis
  misc_feature (46)..(46): n = unknown
  misc_feature (185)..(186): n = unknown
  misc_feature (192)..(192): n = unknown
  misc_feature (273)..(273): n = unknown
tacttcatgtattaagcattttgtatgaatattatgtagtcgatgngtctctaatatattactgttgagcaacatatttttatagataagagtagatgtaataattcattttaagaattgagttactagaattattctattatgctgtattatatgttaatataactatattaaaagaaaaattnntttttnaaaaaaaaaaaaaaaaaaaaaaaaaaaaaaaaaaaaaaaaaaaaaaaaaaaaaaaaaaaaaaaaaaaaaaaaaaaaaaaan

SEQ ID NO: 1341 - DNA, 372 bp, Ctenocephalides felis
aaaatccatttaatgaacatcatgaacaccatgtaggcaaagagaagaactaagaagaccaattggggcaagaattctactaatatgctgatcttctggcggaaatgaacgtgattgaaaacggccatgcaaactccaaaaatcatgtgaacgacgccgaaaatgatagacaacttcattttgaaggagttcaagaaaataattttgttggtagccagctgccacattggatctaaaccaataggatatgcttctccagcatctgtttttgggtcaagagttaattcttcattctccatcacagtggatgaattataatttaatgtccatccagaaccaaaaatgttcatggataaggagaaaatatcgttg

SEQ ID NO: 1342 - DNA, 500 bp, Ctenocephalides felis
  misc_feature (50)..(50): n = unknown
  misc_feature (60)..(60): n = unknown
  misc_feature (114)..(114): n = unknown
  misc_feature (171)..(171): n = unknown
  misc_feature (236)..(236): n = unknown
  misc_feature (294)..(294): n = unknown
  misc_feature (444)..(444): n = unknown
  misc_feature (446)..(446): n = unknown
  misc_feature (449)..(449): n = unknown
  misc_feature (454)..(454): n = unknown
  misc_feature (458)..(458): n = unknown
  misc_feature (486)..(486): n = unknown
  misc_feature (490)..(491): n = unknown
  misc_feature (497)..(497): n = unknown
ttttttttttttttttttttaatttcataaagcttctatatttatatatnggaaataatnagaaattactatagttaatgacattttgtttgtgctccttacataaaatacaantttatacattttaatttttatacatattttttatatttaattgcacagatcatttgngtatttattatattaattgactactttatgataatttgaatcctaattagtctattcaagattgntttcctggtttaagccttacttagcaatctcacttttgcattcttcgccgggtggcgngggtatgcatcgcaactccgttttatcaaaggcaagccatttggcaatcataatggtttatttgccattggtggtaaccaagaaacattgataatatttttacaatctcttcgacggaaaaacgtttcacttttggatgcagtttgcacnanaanatttnggtnaaacatcgtgcggccggcttaaatttanaacnngccggnggc

SEQ ID NO: 1343 - DNA, 486 bp, Ctenocephalides felis
  misc_feature (44)..(44): n = unknown
  misc_feature (52)..(52): n = unknown
  misc_feature (120)..(120): n = unknown
  misc_feature (128)..(128): n = unknown
  misc_feature (130)..(130): n = unknown
  misc_feature (199)..(199): n = unknown
  misc_feature (331)..(331): n = unknown
  misc_feature (367)..(367): n = unknown
  misc_feature (374)..(374): n = unknown
  misc_feature (405)..(405): n = unknown
  misc_feature (408)..(408): n = unknown
tttttttttttttttcttacggcccaaacgatttatttttattnaaaagatncatgtaatttcataaagcttctatatttatatattttaaataatcagaaattactatagttaatgacnttttgttngngctccttacataaaatacaattttatacattttaatttttatacatattttttatatttaattgcacanatcatttgggtatttattatattaattgactactttatgataatttgaatcctaattagtctattcaagattgttttcctggtttaagccttacttagcaatctcacttttgcattcttcgccggggggcgngggtatgcatcgcaactccgttttatcaaagtgcangccattnggacaatcataatgttttatttgccatttgntgntaaccaagaaacattgataatattttttacaatctcttccatcggaaaaaacgtttcacttttgcatgcagtctgccg

SEQ ID NO: 1344 - skipped

SEQ ID NO: 1345 - DNA, 174 bp, Ctenocephalides felis; identical to SEQ ID NO: 859

SEQ ID NO: 1346 - DNA, 360 bp, Ctenocephalides felis
  misc_feature (104)..(104): n = unknown
  misc_feature (287)..(287): n = unknown
aagaattgggatttgtgcatttcatgacggtgcaatcagcttctgacgatttctttttacacatatttttagaatgatcatatacatagttaggtgggcattcnaaaacctggcctttaccatctttgcagaataagtatcttgtgcaagtctttcggatctggctgatatcctacaaccgcgcatgtagtttctgccgtcttacagttttccccaggttttgatgagcacatatcatctacacaaaatggagcatcggaatttgagtctctgcaattgattggtgnaattggggtttcttgccagcgcacaacttcaaagtagaacaatcgtgacaaaatgttccaactgcttattagt

SEQ ID NO: 1347 - DNA, 406 bp, Ctenocephalides felis
  misc_feature (28)..(28): n = unknown
  misc_feature (63)..(63): n = unknown
  misc_feature (65)..(65): n = unknown
  misc_feature (98)..(98): n = unknown
  misc_feature (129)..(129): n = unknown
  misc_feature (302)..(302): n = unknown
  misc_feature (377)..(377): n = unknown
ttctcaagaacgagagtaaaataatctntttattattaattgtgcacttttaaaatataagtntngatgaaattgtatatcatttcttcatatcttanatctcattttgaggtaaattattgaaacacnatttataaaaaagggatagggatggaaatagaatatgaattcgacaatattaattagtagaagtaaataattatttatatactactaataccatatagtttgattttgaatgtatacttgttgtgggcatttcaataataaaaaacgataaaaaatgaaataattatacagtntttatgaatgagcttaaaaaaattgctattaacgatccataatttttgcttcaaatgagcccacaaataaagcanatggacattagcaaatatatctcaaaaag

SEQ ID NO: 1348 - DNA, 417 bp, Ctenocephalides felis
  misc_feature (56)..(56): n = unknown
  misc_feature (147)..(150): n = unknown
  misc_feature (284)..(284): n = unknown
aattcggtaatactaggaatgtaaaacaaaaatataatagaacaataattcggttnggacaaagatattgtattttaattttaatttatattgatcacaaattaataactcgttacattgtaataatactaaacaatctatttacannnnaaaacactcctttcgcaaactttaattctccttcttgatgcgtgtggatgtcattctgtaaataatggagtccctgccagggtccattgtggagatcgagatacagatagcaagtaacgagaagaaaaaggctnctccgaaccataaaatgatgttaaaaaccaccgggtaggagtcgttgtattctttagctaggttgaaatcgggttcttttggagcatcatctgcttgccttgcttacgtgttaagacgtcattagagggtagt

SEQ ID NO: 1349 - DNA, 376 bp, Ctenocephalides felis
  misc_feature (12)..(12): n = unknown
  misc_feature (32)..(32): n = unknown
  misc_feature (58)..(58): n = unknown
  misc_feature (66)..(66): n = unknown
aatggtattatnttttattcaggctggctganttatgtgtaaattattgaaaaactgntaactatngaacatatatatataaatataggttaaatattgtaaattttatttaagtcttcaaaccgaccctacatgtccccttgaaattttacttccccgtgtagaaaaatgtcttttcgatatattggtgtatatcttgatgtattctagtttattataatttgttgcaagtttgttgttcaaaatgataataatacatatgatacacaataataggataatgattaacaatacaaaaaaccatattatgtagtgtgtattatttgaaacatgtaaataaaaacattccacacaaaaaaaaaaaaaaaaaaaaaaa

SEQ ID NO: 1350 - DNA, 445 bp, Ctenocephalides felis
  misc_feature (58)..(58): n = unknown
aacaaaaaataaaaaataacccattttactggattcatttgaataataaatatgtggnttctgtattttttttttcttaaaaaaaataaccaatatctacaattgtctttgacacaatatattaataacagacactaacatagtatttgaaataacatagtattaatatttgtattaaggcactcaatactataggaatacttggaacgcgcattgctaaattcctcgcttatccaaaatacgtataaatacttattatcaattataggggcatattgctaaatgacttaaaatcaataaaaagcgaatctcgcgtataaaaaaatgccatcatcatatctcactgtgtgtaaaaatattaaaaatttgatcacgatgattttgctgatcacaacttatgctagactcacaatatgtgaattaaacatgagctctcttatatttg

SEQ ID NO: 1351 - DNA, 229 bp, Ctenocephalides felis
  misc_feature (217)..(217n = unknown)
  misc_feature (217)..(217): n = unknown
aacatttcagactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactncaaaaccacggt

SEQ ID NO: 1352 - DNA, 457 bp, Ctenocephalides felis
  misc_feature (65)..(65): n = unknown
  misc_feature (407)..(407): n = unknown
  misc_feature (409)..(410): n = unknown
  misc_feature (412)..(413): n = unknown
  misc_feature (420)..(420): n = unknown
  misc_feature (422)..(424): n = unknown
  misc_feature (426)..(426): n = unknown
  misc_feature (429)..(429): n = unknown
  misc_feature (433)..(434): n = unknown
cctagtgagtgtgttatatgaaattgctattgcatattacatacaagcttaataaaggttatggngatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattacgcaatgatttatcactattatttattcaacattttatttaactgcttgcaacttttaataaaacgcattttttattgttttaagtataaatcttattagggcacaatatgaaaataaaaataagaactttatcanannannaaatttnannntnttncctnnaaaaaaaaaaaaaaaaaaaaaaa

SEQ ID NO: 1353 - DNA, 406 bp, Ctenocephalides felis
gagcggcccgcccgggcagtacatatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttcaacaacacttcctaatcgacccatcattaaagatatacatactgccattgccctgagttgtgtaggg

SEQ ID NO: 1354 - DNA, 455 bp, Ctenocephalides felis
  misc_feature (45)..(45): n = unknown
  misc_feature (191)..(191): n = unknown
  misc_feature (399)..(399): n = unknown
  misc_feature (425)..(425): n = unknown
taaaaagcgattttgataaatttgctattgtgtggagctgcacanttcatccacgaggaaaaatggaattagcttggattctcacacgtgagcaaaacccatcatcggaattgatgaaagaaattaagacatatgtggaaaacaatacacccatagatttgagcaaactaaaacacaccgagcaaaattgnggaaaggattattgaagataattgctgtatataaagtcattttaagacacagctttatcaaaacaacaacaacatatgtttaagaataactaaatatattatacttaatacttagcttttcctggcaatactatatgaaactattggcataagtgcattaatatttttataatagatttgctttctatattcaatatatataatatgnattaataataaattcttctatcaagntttaaaaaaaaaaaaaaaaaaaaaaaaaaa

SEQ ID NO: 1355 - DNA, 421 bp, Ctenocephalides felis
  misc_feature (67)..(67): n = unknown
  misc_feature (230)..(230): n = unknown
  misc_feature (421)..(421): n = unknown
ttcgtgatttccctgaattgagtgttgaaatcgacggcgtaactgaatctattatgaagcgtactgntcttgtcgcaaacacatctaacatgcctgtcgccgctcgtgaagcttcatttacaccggtatcactctcagtgaatacttccgtgatatgggttacaacgtatctatgatggctgattccacttctcgttgggctgaagctttgagagaaatttcaggtccgnttggctgaaatgcctgccgattccggttatccagcgtacttgggagctaggttggcctctttctacgaacgtgctggccgtgtaaaatgtttgggtaatcctgaacgtgaaggctcagtatcaattgtaggagctgtatcaccgccggtggtgacttctcagatccgcacttcagctacattgggtattgn

SEQ ID NO: 1356 - DNA, 313 bp, Ctenocephalides felis
  misc_feature (63)..(63): n = unknown
  misc_feature (222)..(222): n = unknown
aattcttggctataagttcgttgcatgttttgcaagtgatttgtttattgcatttattcccgnggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgnttcttagttctggaagtttttgaacgttacaacccgatttctcgcaacacattttttctcggttagtcgagtcacaactttctttaaccgt

SEQ ID NO: 1357 - DNA, 494 bp, Ctenocephalides felis
  misc_feature (8)..(8): n = unknown
  misc_feature (18)..(18): n = unknown
  misc_feature (52)..(52): n = unknown
  misc_feature (86)..(86): n = unknown
  misc_feature (116)..(116): n = unknown
  misc_feature (165)..(165): n = unknown
  misc_feature (302)..(302): n = unknown
tttttttntttttttttntttttaatttcataaagcttctatatttatatgnttgaaataatcagaaattactatagttaatgacnttttgtttgtgctccttacataaaatacanttttatacattttaatttttatacatattttttatatttaattgcacanatcatttgtgtatttattatattaattgactactttatgataatttgaatcctaattagtctattcaagattggtttcctggtttaagccttacttagcaatctcacttttgcattcttcgccgggtggcgtgggtntgcatcgcaactccgctttatcaaagtgcaagccatttggacaatcataatgttttatttgccatttgttgttaaccaagaaacattgataatattttttacaatctcttcgatcggaaaaaacgtttcacttttgcatgcagttctgcacgagaaagattttgggtcaaaccattcgttgacgcgcttcac

SEQ ID NO: 1358 - DNA, 409 bp, Ctenocephalides felis
  misc_feature (93)..(93): n = unknown
  misc_feature (113)..(114): n = unknown
  misc_feature (171)..(171): n = unknown
  misc_feature (236)..(236): n = unknown
  misc_feature (245)..(245): n = unknown
  misc_feature (315)..(315): n = unknown
  misc_feature (351)..(351): n = unknown
  misc_feature (370)..(370): n = unknown
ttttttttttttttttttttgatttcataaagcttctatatttatatattttaaataatcagaaattactatagttaatgacattttgtttgngctccttacataaaatacanntttatacattttaatttttatacatattttttatatttaattgcacagatcatttgngtatttattatattaattgactactttatgataatttgaatcctaattagtctattcaagattgntttcctggnttaagccttacttagcaatctcacttttgcattcttcgccgggtggcgtgggtatgcatcgcaactccgntttatcaaagtgcaagccatttggcaatcataatgntttatttgccatttggtgntaaccaagaaacattgataatattttttacaatctcttc

SEQ ID NO: 1359 - DNA, 500 bp, Ctenocephalides felis
  misc_feature (1)..(1): n = unknown
ncaaaattccaaattttagtttataaatcatcttatatggaaactgtctgcaacaaaccagattttaaaatagaatccaataaatacggatataaaattttattaaaatacacaaacataacaaatgtcgttaattactaattcaaagtttcatacgatatgtcatatgctaattttagatttattatcataaataaatttattatttaaatcatattagaggaaaaaaaaatattttctcaattctctccttcaaaacttctttgcacttctccggctccatacagttttaataccacttttttcacaaaattcaacatttttgtaaaatccattgtgaaaattcatttggctgtttattaaaagacatcatcccttcggaatctgttatataccccaaaccagcactcttcaaatcacaaaatcctttttcaagttaacctcgaacgttacccatatttggaaggtccttttggattcaacattgaattggtttcgat

SEQ ID NO: 1360 - DNA, 118 bp, Ctenocephalides felis
  misc_feature (26)..(26): n = unknown
  misc_feature (30)..(30): n = unknown
catcaccgagaagaactcttcggctncggnatatcttcattggaggcgcgttgttggtgcacgcagcattaacaaggttcttgcaattcagcataatgaccagaagaaaaatacaggt

SEQ ID NO: 1361 - DNA, 500 bp, Ctenocephalides felis
  misc_feature (33)..(33): n = unknown
  misc_feature (61)..(62): n = unknown
  misc_feature (67)..(67): n = unknown
  misc_feature (96)..(96): n = unknown
  misc_feature (104)..(104): n = unknown
  misc_feature (154)..(154): n = unknown
  misc_feature (208)..(208): n = unknown
  misc_feature (223)..(223): n = unknown
  misc_feature (241)..(241): n = unknown
  misc_feature (340)..(341): n = unknown
  misc_feature (349)..(349): n = unknown
  misc_feature (356)..(356): n = unknown
  misc_feature (445)..(445): n = unknown
  misc_feature (467)..(468): n = unknown
cctagtgagtgtgttatatgaaattgctattgnatattacatacaagcttaataaagggtnnggggntttatttcatttaaaggcaatgtatcggnttaatggntttaaatttattttttatttaatattaaatagattaattaaaaatctatnaagtgataagaggcctgatatccataatattattgaatattaagaagtgacggntagatctgataatgnagtagttggtatagacancttacttaataattatgagttgcatcattatgcaatgatttatcactattatttattcaacattttatttaactgcttgcaacttttaataaaacgccnntttattgntttaagnataaatcttattagggcacaatatgaaaataaaaataagaactttattcaaaagctttttttatacaatatgcttcttgcgctttaagntaagaaatttatttatgcttgnnaaaaacaataaatgctttattattaaaaaaaa

SEQ ID NO: 1362 - DNA, 287 bp, Ctenocephalides felis
tatcaagcaaactgaatttgatctgaggtaaaactgaattcaagacataaaagcatcaccaaatatgtatagataaaagataaagattgtaaaaagtttgagaaacactgtttggatggtgaaacgaaatatagaaaacacaaaagttaaaatatatatatactcagccccaaataatataatttaaaattatggttaagtttgtttagtagctcagtggtaatagcattagccttgcaaccagaattgcagattccattccctcattaaacctgatatcgagcagt

SEQ ID NO: 1363 - DNA, 147 bp, Ctenocephalides felis
  misc_feature (32)..(32): n = unknown
  misc_feature (130)..(130): n = unknown
attaactacttttgatgcataaaaagctgcanaagagtgcactaatcgattatgttgaggccacttcattaacacctttgttctaggtatgttatatacctctggtttggctagtcttagaacgcattgnttgtgtgaggctttagt

SEQ ID NO: 1364 - skipped

SEQ ID NO: 1365 - DNA, 420 bp, Ctenocephalides felis
  misc_feature (157)..(157): n = unknown
  misc_feature (267)..(267): n = unknown
  misc_feature (295)..(295): n = unknown
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggngggcattcgaaaacctgacctttaccatctttgcagaataagtatcttgtgcagctttcggatctgggtgatatcctacaaccgcgcatgtagtttctgccgcttacagntttccccaggttttgatgagcacatatnatctacacaaaatggagcatcggaatttgagtctctgcaattgattgttgtaattggggtttcttgtcagcgcacaacttcaaagtagaacaatcgtgacaaaatgttcccaactgcttattagt

SEQ ID NO: 1366 - DNA, 250 bp, Ctenocephalides felis
aataaatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttcggcaagaacattccggaagtcgcgcccaccatcatcattacggaaagt

SEQ ID NO: 1367 - DNA, 387 bp, Ctenocephalides felis
  misc_feature (38)..(38): n = unknown
aatgcattgacaagaaccattcttgaatcctggtctanatcaccggctttgatcaaatcatgaattttgtcatgagttttttcttcaacccaagtgttgataactttagcgctttcagcattttgggcaaagttcaagttttctgctccagctaagaatttgttggtggcaacttctttgaaggtgggttttaatgtatagccttccataacataaactttattggcaatttccagagttacacctttttgtgtattaagagtgttcatcaatgcgtggtagtcatcttgaattttttcttttgattgaggctgacgtaaaccagcagctatttgtgtggcagtattaccaccagctcccattgacaccagggatagaacagtttgt

SEQ ID NO: 1368 - DNA, 448 bp, Ctenocephalides felis
  misc_feature (53)..(53): n = unknown
  misc_feature (57)..(57): n = unknown
  misc_feature (129)..(129): n = unknown
  misc_feature (238)..(238): n = unknown
  misc_feature (310)..(310): n = unknown
  misc_feature (341)..(341): n = unknown
ttttttttttttttttttttttttgaaccattttataaaattttataatcaantcantactataaatttataataatatcaataacaaaagttattttatagtagtcataatatactttgcattaatanttcatacacacacacacacattacttgtcttttcaattccaatttgttcttattctcgtccttgttcaaatgtcgatgttcaatgttgtattaagcattctattgtgantttagtattggatttcttaacattaaagcagcttctgatgatattattggcaacgcattgacacaatgatantttattaaatgtgaaatactttcaaacattntatctctggtgtcgaaccactcctttaggatcaataagtaataaatgcttcttattaactccttgaataccagtcagcacatattgccaggacttgctcgtgactct

SEQ ID NO: 1369 - DNA, 498 bp, Ctenocephalides felis
  misc_feature (58)..(58): n = unknown
  misc_feature (95)..(95): n = unknown
  misc_feature (349)..(349): n = unknown
  misc_feature (412)..(412): n = unknown
  misc_feature (489)..(489): n = unknown
ctagtgagtgtgttatatgaaattgctattgcatattacatacaagcttaataaaggntatggtgatttatttcatttaaaggcaatgtatcggnttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgntttaagtataaatcttattagggcacaatatgaaaataaaaataagaactttatcaaaagctnttttatacaatatgcttcttgcgctattaagtaaagaaattttatttatgcttgtaaaaaacaataaatgcttattntttaaaaaa

SEQ ID NO: 1370 - DNA, 405 bp, Ctenocephalides felis
  misc_feature (41)..(41): n = unknown
  misc_feature (43)..(43): n = unknown
  misc_feature (94)..(96): n = unknown
  misc_feature (121)..(122): n = unknown
  misc_feature (194)..(194): n = unknown
  misc_feature (372)..(372): n = unknown
ttttgctctttaacaaattgtttatttatattgtagtattngntttaaatataacttgtgccagattcttcttttctaaaacgaattgatatannnttatagatatatttagaaatattgnntttgggcatggagggtaaaagtaattgacgtttgaatggaaaaaatgggtctttgtatatatggaacttganttttatgttttgtgaccctaaaaagaaatcttcctgagagaatcaatttcttctttgctccacaaatgtaacacacatacacacagggtctgttcaaacatcgggaaatatatgactatatatattctatcattttcataccttttatactaaacatttatatttggtaaaagaatgnatgcttattattatataaatgctaaatattatg

SEQ ID NO: 1371 - DNA, 311 bp, Ctenocephalides felis
  misc_feature (66)..(66): n = unknown
aattcttggctataagttcgttgcatgttttgcaagtgatttgtttattgcatttattcccgtggnatattttacatgaatcagagtttgcattacaatcgttaccctgatctgatttgcatcctcgagtaatgacacctttttcaatttttgaatagcagtcgcctttggattcatacaaactttggtcttcgctttcctgcatctttgaaacattcgtttcttagttctggaagtttttgaacgttacaacccgatttctcgcaacacattttttctcggttagtcgagtcacaactttctttaaccgt

SEQ ID NO: 1372 - DNA, 386 bp, Ctenocephalides felis
  misc_feature (65)..(65): n = unknown
  misc_feature (237)..(237): n = unknown
cctacacaactcagggcaatggcagtatgtatatctttaatgatgggtcgattaggaagtgttgntggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttncgtcgtgtgttgtgaaatgcaattatactttgagaaagtattatcgattacaaagaaaattcagaagttgctactgaatcattttctaaaacatcgacatgaaaattaataactctttattgttattagattcgatgtaagatatatgt

SEQ ID NO: 1373 - DNA, 286 bp, Ctenocephalides felis
  misc_feature (30)..(30): n = unknown
tatcaagcaaactgaatttgatctgaggtnaaactgaattcaagacataaaagcatcaccaaatatgtatagataaaagataaagattgtaaaaagtttgagaaacactgtttggatggtgaaacgaaatatagaaaacacaaaagttaaaatatatatatactcagccccaaataatataatttaaaattatggttaagtttgtttagtagctcagtggtaatagcattagccttgcaaccagaattgcagattcattccctcattaaacctgatatcaagcagt

SEQ ID NO: 1374 - DNA, 378 bp, Ctenocephalides felis
  misc_feature (35)..(35): n = unknown
  misc_feature (284)..(284): n = unknown
ttttttttcttaaaaaaaataaccaatatctacanttgtctttgacacaatatattaataacagacactaacatagtatttgaaataacatagtattaatatttgtattaaggcactcaatactataggaatacttggaacgcgcattgctaaattcctcgcttatccaaaatacgtataaatacttattatcaattataggggcatattgctaaatgacttaaaatcaataaaaagcgaatctcgcgtataaaaaaatgccatcatcatatctcactgtgtgnaaaaatattaaaaatttgatcacgatgattttgctgatcacaacttatgctagactcacaatatgtgaattaaacatgagctctcttatatttg

SEQ ID NO: 1375 - DNA, 421 bp, Ctenocephalides felis
  misc_feature (228)..(228): n = unknown
  misc_feature (366)..(366): n = unknown
gatcggttgcaatttgtcattgcaccaagcataaattgatgggtccggtgcatagggggggaaaagaattgggatttgtgcatttcatgacggtgcaatcagcttctgacgatttctttttacacatatttttagaatgatcatatacatagttaggtgggcattcgaaaacctgacctttaccatctttgcagaataagtatctttgtgcagtctttcggatctggntgatatcctacaaccgcgcatgtagtttctgccgtcttacagttttccccaggttttgatgagcacatatcatctacacaaaatggagcatcggaatttgagtctctgcaattgattgttgtaattggggtttcttgncagcgcacaacttcaaagtagaacaatcgtgacaaaatgtcccaactgcttatta

SEQ ID NO: 1376 - DNA, 367 bp, Ctenocephalides felis
  misc_feature (57)..(57): n = unknown
  misc_feature (74)..(74): n = unknown
  misc_feature (269)..(269): n = unknown
  misc_feature (284)..(284): n = unknown
  misc_feature (303)..(303): n = unknown
  misc_feature (314)..(315): n = unknown
tatttatttccaatttgcaaatatggaaactaccatccctatattatatataattgnatatattcctgaactgntttatttgaatttattttaaacacaaactttaattatattcaaataatgatggacgtgatttcatatatccctaaactttggatcagagtttgagagaagcctagccatagtgtatagaaaattatgtgtaggtgtataattaagattgtcaggagtcaaatatataaagcattgatacaaattatacattccanttttctgtaaaccgngttctttggtgattatggnttatatcacannttatgaatcatgtaaattaattgtaaatttgaaatgtatctccgtgtaatgt

SEQ ID NO: 1377 - DNA, 425 bp, Ctenocephalides felis
ataagtcatttgaaaataagcatttctgtagtggtgtcttcctggatgttcgacaagcattcgataaggtttggcacccaggacttttatataaaataaaagcatatcttccttcaaggatttttcaagtaaaagtaaatcaagtaacatctgatttccacaaaataatgtcgggagttccacaaggtagtatttttggacctttcttatatgttttatacacaaaggacctcccattacttgaaaatctgacacttgctacattcgctggcgatattgccatactaagtagtaatcacagtactgatcaagcttcccgacaaacgcaagaacatatcaataaactacaaatgtggcttactaaatggaagatttgcataaatgaaaccaaatcagttcatatcacatttaccctgagagagggt

SEQ ID NO: 1378 - DNA, 384 bp, Ctenocephalides felis
  misc_feature (138)..(138): n = unknown
tggcaagcagatgatgctccaaaagaacccgatttcaacctagctaaagaatacaacgactcctacccggtggtttttaacatcattttatggttcggagtagcctttttcttctcgttacttgctatctgtatctcnatctccacaatggaccctggcagggactccattatttacagaatgacatccacacgcatcaagaaggagaattaaagtttgcgaaaggagtgtttttaattgtaaatagattgtttagtattattacaatgtaacgagttattaatttgtgatcaatataaattaaaattaaaatacaatatctttgttgaaatcgaattattgttctattatattttgttttacattcctagtattaccgaattg

SEQ ID NO: 1379 - DNA, 498 bp, Ctenocephalides felis
  misc_feature (61)..(61): n = unknown
  misc_feature (87)..(87): n = unknown
  misc_feature (119)..(119): n = unknown
  misc_feature (308)..(308): n = unknown
  misc_feature (313)..(313): n = unknown
  misc_feature (346)..(346): n = unknown
  misc_feature (434)..(434): n = unknown
tgaaatgtgaagacgacgtcaacgaatggtttgacccaaaatctttctcgtgcagaactgngtgcaaaagtgaaaacgttttttccnatcgaagagattgtaaaaaatattatcaatgnttcttggttaacaacaaatggcaaataaaacattatgattgtccaaatggcttgtactttgataaaacggagttgcgatgcatacccacgccacccggcgaagaatgcaaaagtgagattgctaagtaaggcttaaaccaggaaaacaatcttgaatagactaattaggattcaaattatcataaagtngtcanttaatataataaatacacaaatgatctgtgcanttaaatataaaaaatatgtataaaaattaaaatgtataaaattgtattttatgtaaggagcacaaacaaaatgcattaactatagtantttctgattatttaaaatatataaatatagaagcttatgaaatcaaaaaaaaaaaaaaaaaaaa

SEQ ID NO: 1380 - DNA, 422 bp, Ctenocephalides felis
atcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagtgcacaacttcaaagtagaacaatcgtgacaaaatgttcccaactgcttattagt

SEQ ID NO: 1381 - DNA, 268 bp, Ctenocephalides felis
  misc_feature (30)..(30): n = unknown
agatctactaatgccgcgtttaccactgtnacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttcaacattaaagaatgcataaatgcctgttcttccattgtgtctttacactcggtcgt

SEQ ID NO: 1382 - DNA, 498 bp, Ctenocephalides felis
  misc_feature (90)..(90): n = unknown
  misc_feature (326)..(326): n = unknown
  misc_feature (373)..(373): n = unknown
  misc_feature (385)..(385): n = unknown
gaggagactttgtttaccgtaatggacaaccattcgaaattccaaaaggaaatttactattgaatgattaaatgtaatagattaatcaanttttagatgattaaaattgttctattactacaatagcaacctctgcctgaaaattaaccgaacaaacttctaacatccttattaatgtatagattttgaataataacatagaaattatactctttttttgatgactctaataaaaaaaatgtataaatggccatgcctgatatatttttgataaccttaatgaaaaaatgtttaaatggccatgtctgaaaagatttctatgtgtntttttttgttaacattttattgttgaatggataaaagataaataccntttataagctgnttggataaattaattttgaataaatccataatcatagaatatgttaagtagcaaattaaaatatggcccaaaccacaaaatgtatacgaaatataacttatatgatattaaaa

SEQ ID NO: 1383 - DNA, 230 bp, Ctenocephalides felis
tgaaaatagaacgtctgaatcgctaccaaggtgttaacctgtatgtcaagaaccttgatgacacaatcgatgatgaaaggctgcgcaaggagttcacaccgtttggtacaatcacatccgcaaaggtgatgactgaggatggaagaagcaaaggatttggatttgtttgcttctcttctcctgaagaagctacaaaggcagtcactgagatgaatggacgcattgtgggt

SEQ ID NO: 1384 - DNA, 460 bp, Ctenocephalides felis
  misc_feature (53)..(54): n = unknown
  misc_feature (174)..(174): n = unknown
  misc_feature (191)..(191): n = unknown
  misc_feature (303)..(303): n = unknown
  misc_feature (335)..(335): n = unknown
aattccaaaaggaaatttactattgaatgattaaatgtaatagattaatcaanntttagatgattaaaattgttctattactacaatagcaacctctgcctgaaaattaaccgaacaaacttctaacatccttattaatgtatagattttgaataataacatagaaattatctntttttttggtgactctnataaaaaaaatgtataaatggccatgcctgatatatttttgataaccttaatgaaaaaatgtttaaatggccatgtctgaaaagatttctatgtgtatttttttgttaacantttattgttgaatggataaaagataaataccntttataagctgtttggataaattaattttgaataaatccataatcatagaatatgttaagtagcaaattaaaatatggccacaaacccaaaagtatacgaaatataacttatatgatatatgaaa

SEQ ID NO: 1385 - DNA, 460 bp, Ctenocephalides felis
  misc_feature (57)..(58): n = unknown
  misc_feature (115)..(115): n = unknown
  misc_feature (133)..(133): n = unknown
  misc_feature (160)..(160): n = unknown
  misc_feature (274)..(274): n = unknown
  misc_feature (310)..(310): n = unknown
  misc_feature (314)..(314): n = unknown
  misc_feature (344)..(344): n = unknown
  misc_feature (450)..(450): n = unknown
aactttgtcttttaccaaaagtccttacatcaactcggtatactcataatttaatannttttaattgatgtcgaccctacgttgtcgcaatgtttactaactttcaaattcttgnaacttttaaactgtttgnttaatttaaatgaaatatttggcaaanttgttcaaaattaaatagtctataactttttctaacatcctaagtcatagagcaactcggtatctgaaaaattaataattttaaattgatgtcgacactacgttgtcgcaatgnttattaactttaaaattcttgtaacttttgaatggnttgnttaatttgaatgaaatatttggcaaattgnttgaaattaaataatttacaactttgtctaacatcttaagtcatagagcaactcggtatactcataaataataatttctgatggtttcctggaagattacttgtcntggtgaaagt

SEQ ID NO: 1386 - DNA, 425 bp, Ctenocephalides felis
ataagtcatttgaaaataagcatttctgtagtggtgtcttcctggatgttcgacaagcattcgataaggtttggcacccaggacttttatataaaataaaagcatatcttccttcaaggatttttcaagtaaaagtaaatcaagtaacatctgatttccacaaaataatgtcaggagttccacaaggtagtatttttggacctttcttatatgttttatacacaaaggacctcccattacttgaaaatctgacacttgctacattcgctgacgatattgccatactaagtagtaatcacagtgctgatcaagcttcccgacaaacgcaagaacatatcaataaactacaaatgtggcttgccaaatggaagatttgcataaatgaaaccaaatcagctcatatcacatttaccctgagagagggt

SEQ ID NO: 1387 - DNA, 118 bp, Ctenocephalides felis
  misc_feature (70)..(70): n = unknown
catcaccgagaagaactcttcggctacggaatatcttcattggaggcgcgttgttggtgcacgcagcatnaacaaggttcttgcaattcagcataatgaccagaagaaaaatacaggt

SEQ ID NO: 1388 - DNA, 320 bp, Ctenocephalides felis
agtatctcacaccgcctcttatttgcgtctgtgggccctgtcacttgctcacgcacaactttcagacgtattgtggaaaatggtgttgtccatgggattgaaccaaacaacatatactggctcgattatgctctatgtgatattctgcgtgtgggcactattcacaattgccatcctagtcatgatggaaggcctttctgcgttcttgcacacactgcgtcttcactgggtggagttcatgagtaagttctactctggtttgggttatttgttccaacccttctgcttcaaaactattttggacgcggaggataaggaag

SEQ ID NO: 1389 - DNA, 204 bp, Ctenocephalides felis; identical to SEQ ID NO: 697

SEQ ID NO: 1390 - DNA, 119 bp, Ctenocephalides felis
  misc_feature (63)..(63): n = unknown
ccatcaccgagaagaactcttcggctacggaatatcttcattggaggcgcgttgttggtgcangcagcattaacaaggttcttgcaattcagcataatgaccagaagaaaaatacaggt

SEQ ID NO: 1391 - DNA, 457 bp, Ctenocephalides felis
  misc_feature (43)..(43): n = unknown
  misc_feature (45)..(45): n = unknown
  misc_feature (63)..(63): n = unknown
  misc_feature (97)..(98): n = unknown
  misc_feature (118)..(118): n = unknown
  misc_feature (299)..(299): n = unknown
  misc_feature (375)..(375): n = unknown
  misc_feature (379)..(379): n = unknown
taacaggactatccatcttgatttcatctgcagattttctagntnttcttattactgcagggnatttcatgttttatattatttgaatctaagtcannttttgaaatttcatctgcanatctacgactttttctaattgcagccaatgataatgcatcaatttgatggacatcatttttgggtggttcaatattagctgctgcatctaattctactacagacggaagattttctgtgcagtcctccaatttttttgtgtctctcaaccttgaatttctcgtaaccctcatatttgtagnttctttcaattttgattcactatttgttacgtccaagcttaattttttattttttttagtaactttcttgactggnttgntgaatggtgtctcaaagtctttttgatttgaattactattttctcttactattttagattccttttgcaagattcttg

SEQ ID NO: 1392 - DNA, 424 bp, Ctenocephalides felis
  misc_feature (38)..(39): n = unknown
  misc_feature (87)..(87): n = unknown
  misc_feature (141)..(141): n = unknown
  misc_feature (261)..(261): n = unknown
cttgcttgtggaggcagcagtggattttgctcaatatnnccaaaaacaataattacaaacttttgtcaaaaacaagatcataactgnttatataatataagaagttcttataataaaagtgcagtattatttttacatcantttaaacatcactaaaatcaaaacctaacctcaaaatttcactaagtgaaaatgttgaagactttatttaatcaaagtgtaccgacaaaacagcactaatgcctccttagtaagtacagnttttcacaatagaaaccctagaaatttagaacgaatgaggattgcttataaacctgatggatggcatgtagataaacctggacgctcattctggcacaaattagagttaactgaaagctctcgatatataactgcacgagtggtgcattggaaggaaggcctg

SEQ ID NO: 1393 - DNA, 462 bp, Ctenocephalides felis
  misc_feature (16)..(16): n = unknown
  misc_feature (36)..(36): n = unknown
  misc_feature (140)..(140): n = unknown
  misc_feature (177)..(177): n = unknown
  misc_feature (323)..(323): n = unknown
  misc_feature (372)..(372): n = unknown
tttttttttttttaantttatgtatatatattaggnggggaaacaaatagtcacatttacatatccaatactttttaaatcaacatttaaaataaatcatttgatataatttatgaatatttaaaatattcttatatttntaaattacataacggctaaagttaaaaaaatttaatngctggaataaaaaccttccgaataacataatttttttaaaatttcgtttcttttagaacaaaaactatagaattctattttgatcgaaacctggtaatcactttacgtcctgaatgctcatgccattggaataaaatagaatgctnggtataatttatatatgattatttttataatatttggtaatatagatanttcaatatatactctttttgaattaaatagaaataatgattatacacatcatttttaatatacattaaaatccgtcctcgtagtcttgct

SEQ ID NO: 1394 - DNA, 478 bp, Ctenocephalides felis
  misc_feature (31)..(31): n = unknown
  misc_feature (63)..(63): n = unknown
  misc_feature (80)..(81): n = unknown
  misc_feature (120)..(120): n = unknown
  misc_feature (314)..(314): n = unknown
  misc_feature (347)..(347): n = unknown
  misc_feature (388)..(388): n = unknown
  misc_feature (393)..(393): n = unknown
  misc_feature (436)..(437): n = unknown
tgaaatgtgaagacgacgtcaacgaatgggnttgacccaaaatctttctcgtgcagaactgcntgcaaaagtgaaaacgnnttttccgatcgaagagattgtaaaaaatattatcaatgnttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcanttaatataataaatacacaaatgatctgtgcanttaaatataaaaaatatgtataaaaattaaaatgtataaanttgtnttttatgtaaggagcacaaacaaaatgtcattaactatagtannttctgattatttaaaatatataaatatagaagctttatgaa

SEQ ID NO: 1395 - DNA, 385 bp, Ctenocephalides felis
  misc_feature (42)..(42): n = unknown
  misc_feature (58)..(59): n = unknown
atatatcttacatcgaatctaataacaataaagagttattanttttcatgtcgatgtnntagaaaatgattcagtagcaacttccgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttcaacaacacttcctaatcgacccatcattaaagatatacatactgccattgccctgagttgtgtagggt

SEQ ID NO: 1396 - DNA, 377 bp, Ctenocephalides felis
  misc_feature (60)..(60): n = unknown
  misc_feature (293)..(293): n = unknown
aaaaaggatataagaaccgatcctagggctatgagacgattacgaactgctgcagagcgngcaaaaagaactctaccaactagtacggaagcatgtgtggaagttgaagctttgaaggatggtattgatttctgcaccaaaattacaagagcaagatttgaagaattatgctctgatttattccgctctactttacgcccagttgaacaagcgttaagagatgcaaagttagacaaaggagccatacatgatgttgtattggtgggaggttccacaagaatacctaaaattcnatctctgctacaagaattctttgcaggaaagaccttaaattcttccataaatccagatgaagctgtggcttatggtgctgcagt

SEQ ID NO: 1397 - DNA, 500 bp, Ctenocephalides felis
  misc_feature (495)..(495): n = unknown
catttccttgtgctaattcaattgttcggggatgaagtgccagctctggaaccccttgaacaacttcagaaaccaaatcagcaactctagcctgacttgtctgtgaaccagtttgtccaggtgtgttagcagaactttgaatgataagattttggttggcagcaagactctgtccacacatatttctccgtttatgagatgctaaatcattactttgggcaaaagctctaccacaaaccatacaagcgtagggcttttcacctgtatgtgtcctcatatgtatagctaacttatcagatcgtgcaaatcctctgttacaaacactgcatacaaatggtttttctcctgtatgttttctcatatgcaatgtaagatctgtagttcttggataacctttaccacagattttgcaaaaatttgtcatttgaccagtatgtctccgcatatggacggctaaattacttcttgaactgcaacttttaccacaaacactgnataat

SEQ ID NO: 1398 - DNA, 420 bp, Ctenocephalides felis
ttcgtgatttccctgaattgagtgttgaaatcgacggcgtaactgaatctattatgaagcgtactgctcttgtcgcaaacacatctaacatgcctgtcgccgctcgtgaagcttcatttacaccggtatcactctcagtgaatacttccgtgatatgggttacaacgtatctatgatggctgattccacttctcgttgggctgaagctttgagagaaatttcaggtccgtttggctgaaatgcctgccgattccggttatccagcgtacttgggagctaggttggcctctttctacgaacgtgctggcgtgtaaaatgtttgggtaatcctgaacgtgaaggctcagtatcaattgtaggagctgtatcaccgccggtggtgacttctcagatccgtcacttcagctacattgggtattg

SEQ ID NO: 1399 - DNA, 323 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttcattgtgtctttacactcggtcgtactattcgtagcatcaatgcttagggcggacgacttcattgatactacgaatagt

SEQ ID NO: 1400 - DNA, 210 bp, Ctenocephalides felis
  misc_feature (139)..(139): n = unknown
aaggtttcaaatgtccgtcaccatcgagattttatccaaatataaatgattgtcaaagctattattattgtgacgaaaatagtataggaacccaatattattgccccgcaaattttgcatatgatccgttacgtcatanttgcggacctatggctctgggcacaaaatgctatacagttacatgtcctgcacagcctaaggtgcttccgt

SEQ ID NO: 1401 - DNA, 464 bp, Ctenocephalides felis
  misc_feature (57)..(57): n = unknown
  misc_feature (59)..(59): n = unknown
  misc_feature (423)..(423): n = unknown
aactttgtcttttaccaaaagtccttacatcaactcggtatactcataatttaatangnttttaattgatgtcgaccctacgttgtcgcaatgtttactaactttcaaattcttgtaacttttaaactgtttgtttaatttaaatgaaatatttggcaaatttgttcaaaattaaatagtctataactttttctaacatcctaagtcatagagcaactcggtatactgaaaaattaataattttaaattgatgtcgacactacgttgtcgcaatgtttattaactttaaaattcttgtaacttttgaatggtttgtttaatttgaatgaaatatttggcaaatttgtttgaaattaaataatttacaactttgctaacatcttaagtccatagagcaactcggtatactcataaattaataanttctgattgatttcctgaaagattactttgtattggtgaag

SEQ ID NO: 1402 - DNA, 500 bp, Ctenocephalides felis
ctaataatttcaactctatataaagtgcctaaataattatctccttttttagaagctggtgataatttaacttcataattattgatgccacttttagctattaattgcttcagagctacctgcacatgttcagaaaattcttccatgttaaaaaaaatatggaaaactgttaatttttatgtcgtatttgtttgagttttgttatcatatattacacgtaaaacagacaaactccgtaatattatgatggtatatttttttataatatgcttagattaaatctttattaactaccaattataaaagttttgtttgttcaacaaaactttcaaaaccagtcttgacgtcttttaggttttaaccatttaaaaaaaaatataacgccatttaatttaatcactgtggatatattaaactttaaatgcaatttattaatctacaatatacatttttaagacttttgcttcacttttagtaggtatatattcactcttacaatt

SEQ ID NO: 1403 - DNA, 161 bp, Ctenocephalides felis
  misc_feature (19)..(20): n = unknown
  misc_feature (57)..(57): n = unknown
ttttttttttttttttttnntctgaataattttgattagaacaaatatattcatggntttaaaaaaatctaaattgtaaaattcttaaatgccttatcatatttgcgagcctgtgttcaaccataatatttttttatataacacataaagtaaaacaaagt

SEQ ID NO: 1404 - DNA, 412 bp, Ctenocephalides felis
  misc_feature (34)..(34): n = unknown
  misc_feature (59)..(59): n = unknown
  misc_feature (165)..(165): n = unknown
  misc_feature (370)..(370): n = unknown
  misc_feature (383)..(383): n = unknown
  misc_feature (402)..(402): n = unknown
  misc_feature (409)..(409): n = unknown
cgttatttatattatattgtttatacagaaagcnctgttgtatgaaaagtatctgaaancaacacatctcatgtaaggttactttattgtaaaagttattttatatgtaatttttaataacattaaaattattttgttctttctgttagatgaattgtgtgttanatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattgntaaaaatatttgnggctagattttcctattgntaattgngtg

SEQ ID NO: 1405 - DNA, 251 bp, Ctenocephalides felis
  misc_feature (60)..(60): n = unknown
  misc_feature (68)..(68): n = unknown
  misc_feature (110)..(110): n = unknown
  misc_feature (140)..(140): n = unknown
  misc_feature (229)..(229): n = unknown
  misc_feature (231)..(231): n = unknown
atttagaagcccccattatttcttacttttaattttattttcttcatttttatattaacnctatatcnttatctatctatctattaggtcaaccaataaaattaagcgtnaaatgaataattttgattagaacaaatatnttcatggatttaaaaaaatctaaattggaaaattcttaaatgccctatcatatttgcgagcctgtgttcaaccataatatttttttatntnacacataaagtaaaacaaag

SEQ ID NO: 1406 - DNA, 350 bp, Ctenocephalides felis
  misc_feature (60)..(60): n = unknown
taattaattttaaaaaattaaggatagaaaccaacctggcttaaaccggtttgaactcanatcatgtaagaattaatggtcgaacagaccaaattttaaaacttctgcattttaaaattatcttaatccaacatcgaggtcgcaatctattttgccgatatgttctcttaaaaataattacgctgttatcccttaagtaacttaatcttttaatcataatttatggatcaattattcaattatttatgttttaataaaaaaaaagttttataaattttcctatcaccccaataaaatatattaatataaataaaaaaaaaaaaaaaaaagcttgcacaaaaaaaaaaaaa

SEQ ID NO: 1407 - DNA, 477 bp, Ctenocephalides felis
  misc_feature (23)..(23): n = unknown
  misc_feature (25)..(25): n = unknown
  misc_feature (33)..(33): n = unknown
  misc_feature (58)..(58): n = unknown
  misc_feature (110)..(110): n = unknown
  misc_feature (134)..(135): n = unknown
  misc_feature (160)..(160): n = unknown
  misc_feature (234)..(234): n = unknown
  misc_feature (334)..(335): n = unknown
  misc_feature (367)..(367): n = unknown
ctttttaggatatatttgctaangnccatttgntttatttgggggctcatttgaagcnagggagtatggatcggtaatagcccctttttaagctcattcataaatactgnataattatttcattttttatcgcnntttattattgaaatgcccacaacangtatacattcaaaatcaaactatatggtattagtagtatataaataattatttacttctactaattaatattgncgaattcatattctatttccatccctatcccttttttataaatcgtgtttcaataatttacctcaaaatgagatctaaaatatgaagaaatgatatacannttcatctatacttatattttaaaagtgcacanttaataataaaaagattattttactctcgttcttgagaattgagatttggtctttggcaatacacgtaacaatattctgacttttcatagcttttaatataagtaaaagt

SEQ ID NO: 1408 - DNA, 500 bp, Ctenocephalides felis
  misc_feature (29)..(29): n = unknown
  misc_feature (52)..(52): n = unknown
  misc_feature (118)..(118): n = unknown
  misc_feature (126)..(126): n = unknown
  misc_feature (166)..(166): n = unknown
  misc_feature (175)..(175): n = unknown
  misc_feature (372)..(372): n = unknown
  misc_feature (455)..(455): n = unknown
  misc_feature (495)..(495): n = unknown
  misc_feature (497)..(497): n = unknown
tttctttttttttttttttttttttattncataaagcttctatatttaggtnttttaaataatcagaaattactatagttaatgacattttgtttgtgctccttacataaaatacaantttatacnttttaatttttatacatattttttatatttaattgcacanatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgntggtaaccaagaaacattgataatattttttacaatctcttcatcggaaaaaacgttttcactttgcatgcagttctgccganaaagatttgggtaaaccatccgttgcgcgctttacatttnantcc

SEQ ID NO: 1409 - DNA, 425 bp, Ctenocephalides felis
  misc_feature (28)..(28): n = unknown
  misc_feature (273)..(273): n = unknown
  misc_feature (396)..(396): n = unknown
aaattgttgatggcacaactttttgcanaaagttttgtaaactgattaacaaaaaaaggaaacattaccgataagtagaaaataatataactaacagtttgtaatatgctataaatcttaaaacaacactcttgtaacaaaatattatagggagatattgaagtgaaactttaaaggtaaatagaaaagaaagcatttggttgaaaatgatgaaatttgtttcaaaacttctgaacttttctagaaacgttgcaaactgtctgaatttattgnaaattatcaatgtaacttttgcagttttatttacgaagtttcactcctccgcactatttttttttttgcaaataaatttaagattttatgattttttttgtgaacaacgtgcagtatttttgnatggatataaaataataaatctacacatg

SEQ ID NO: 1410 - DNA, 423 bp, Ctenocephalides felis
  misc_feature (52)..(52): n = unknown
  misc_feature (57)..(57): n = unknown
  misc_feature (68)..(68): n = unknown
  misc_feature (207)..(207): n = unknown
  misc_feature (326)..(326): n = unknown
  misc_feature (387)..(387): n = unknown
ccttaaaaaatcatgaatgaaatttggcgaaatgtaaatacaaaaatatatnaaatntttaaaaaatntagtacatattttgatggttacaggaacatgtaccccttcagtatttcttttattttcaattacgaaaatcagaaaacagttattccaagatcatggttcttgtgcccttctttaagcttatttcctatcctaaagtgntaactattactacctaaactgcgatgatatttgtgatgaatgatgttgacatgatgtccgaagacgttggctaagatgcggtataattctgtcctggcatcatcgttccctttcctggnaatctttacttgttcccaatcttcagcacgggcgcctaacgtggagcagcttccgagccantttttaaagacccttacagggccggtgtttttagtg

SEQ ID NO: 1411 - DNA, 422 bp, Ctenocephalides felis
  misc_feature (38)..(38): n = unknown
  misc_feature (53)..(53): n = unknown
  misc_feature (97)..(97): n = unknown
  misc_feature (161)..(161): n = unknown
  misc_feature (350)..(350): n = unknown
  misc_feature (367)..(367): n = unknown
tccgatcgggttgcaatttgtcattgcaccaagcatanattgatgggtccggngcataggttataaaagaattgggatttgtgcatttcatgacggngcaatcagcttctgacgatttctttttacacatatttttagaatgatcatatacatagttaggngggcattcgaaaacctgacctttaccatctttgcagaataagtatcttgtgcagctttcggatctggctgatatcctacaaccgcgcatgtagtttctgccgcttacagttttccccaggttttgatgagcacatatcatctacacaaaatggagcatcggaatttgagtctctgcaattgattggtgnaattgggggttcttgtncacgccaacttcaaagtagaacaatcgtgacaaaatgttccaactgcttattagt

SEQ ID NO: 1412 - DNA, 500 bp, Ctenocephalides felis
  misc_feature (29)..(29): n = unknown
  misc_feature (34)..(34): n = unknown
  misc_feature (151)..(151): n = unknown
  misc_feature (172)..(173): n = unknown
  misc_feature (188)..(189): n = unknown
  misc_feature (201)..(201): n = unknown
  misc_feature (220)..(220): n = unknown
  misc_feature (227)..(227): n = unknown
  misc_feature (230)..(230): n = unknown
  misc_feature (296)..(296): n = unknown
  misc_feature (335)..(335): n = unknown
  misc_feature (426)..(427): n = unknown
  misc_feature (429)..(429): n = unknown
  misc_feature (463)..(463): n = unknown
  misc_feature (484)..(484): n = unknown
ctttccttttttttttttttttttttttntgttnttgaacggcccaaacgatttattttggggggaaaagatacatgtaatttcataaagcttctatatttatatattttaaataatcagaaattactatagttaatgacattttgtttgngctccttacataaaatacaannttatacattttaacnnttatacatattntttatatttaattgcacanatcattnggngtatttattatattaattgactactttatgataatttgaatcctaattagtctattcaagattgcnttcctggtttaagccttacttagcaatctcacttttgcnttcttcgccgggtggcgtgggtatgcatcgcaactccgttttatcaaagtgcaagccatttggacaatcataatgttttatttgccattgnngntaaccaagaaacattgataattttttttacaatntcttccacgggaaaacgcttnacttttgcatgcagtt

SEQ ID NO: 1413 - DNA, 108 bp, Ctenocephalides felis
  misc_feature (3)..(3): n = unknown
  misc_feature (87)..(87): n = unknown
ggntttaaaaaaatctaaattggaaaattcttaaatgccttatcaatatttgcgagcctgtgttcaaccataatatttttttatatnacacataaagtaaaacaaagt

SEQ ID NO: 1414 - DNA, 498 bp, Ctenocephalides felis
  misc_feature (35)..(35): n = unknown
  misc_feature (58)..(58): n = unknown
  misc_feature (65)..(65): n = unknown
  misc_feature (253)..(253): n = unknown
  misc_feature (462)..(462): n = unknown
ctctaaaaatcattgacgctttttcttttcttttnctgcctttggtttagatgggtgncctcggntcaaaaaagacgtaatgacttctgacatttctggcatatcagacatctttgtgaagctgctgagttgctccatttcctttttagtttcaggatcattcatcattttcggtaaaaccatgattaataataatggcaacaccatcattaaaatcataggattgaataggaaatcagtaattttccattgntcccttacttgaaaatatctgaattttcctaatgtctttaatcttaaagggtatggcacttgtatgacttgagatgtttgtatgtgattcactttgcgtgctctgaattttcctttagaggtaatttctactctaacaggctcatacatataatttgaggtaactgcttccaatccgtaagaccagatgggacattcttatacaaaggngccggcttctttcaaaacccttatataagccccgtc

SEQ ID NO: 1415 - DNA, 500 bp, Ctenocephalides felis
  misc_feature (38)..(38): n = unknown
  misc_feature (50)..(50): n = unknown
  misc_feature (54)..(54): n = unknown
  misc_feature (240)..(240): n = unknown
  misc_feature (262)..(263): n = unknown
  misc_feature (304)..(304): n = unknown
  misc_feature (349)..(349): n = unknown
  misc_feature (351)..(351): n = unknown
  misc_feature (386)..(386): n = unknown
  misc_feature (396)..(396): n = unknown
  misc_feature (398)..(398): n = unknown
  misc_feature (425)..(425): n = unknown
  misc_feature (443)..(443): n = unknown
  misc_feature (489)..(489): n = unknown
gccaaatctcgatagttacgccgactcataaataattnttttacaatggnatgntaaaaaaaaattaggggggtgtaaatataatatatggtattgggattaacttagttaattctccctcgcacttttatactatagtaaccagaaacaaaaatcagagtggggtaaaatgtaaattcatatatttttggtgaaaatacaatcaagatataacaggccacaatattattaaaatccgtntttgtgacgaaacctaaagtgnngtcagaatataaaaaacaataatatttataccttcaaatgnatgctttgaaaaaaagcattcgaagattttggttaaatattttgntnagccacatttatgtttgtcgtcaattaaattatgntcttttgcangnaagattatgttgtagatattgcacaanattagtatattttatgtnattttaagcatattggtattttttggaaatcggactattgcaccanattaataaatg

SEQ ID NO: 1416 - DNA, 186 bp, Ctenocephalides felis; identical to SEQ ID NO: 97
  misc_feature (30)..(30): n = unknown
  misc_feature (63)..(63): n = unknown

SEQ ID NO: 1417 - DNA, 498 bp, Ctenocephalides felis
  misc_feature (27)..(27): n = unknown
  misc_feature (30)..(30): n = unknown
  misc_feature (32)..(32): n = unknown
  misc_feature (40)..(40): n = unknown
  misc_feature (59)..(59): n = unknown
gggtatctggcgtcatatgtgggtccnttntntacaatgnatgggcctaatactccganggcatttgaaactatagttccaatggaaattcctgtctgcctcaaacaggttggatatgtttccattgcttgcagattcacaacataaaacgtgatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctccatattgctcacgttcaaaattaatgtaaaatacgtcacggaacatacaatccagcaaagcacaataagtgtagtatttctagctaaacgtaaactagaaaataaactcatgattccgtaaa

SEQ ID NO: 1418 - DNA, 478 bp, Ctenocephalides felis
  misc_feature (31)..(32): n = unknown
  misc_feature (36)..(36): n = unknown
  misc_feature (63)..(63): n = unknown
  misc_feature (85)..(85): n = unknown
  misc_feature (88)..(88): n = unknown
  misc_feature (137)..(137): n = unknown
  misc_feature (162)..(162): n = unknown
  misc_feature (164)..(164): n = unknown
  misc_feature (167)..(167): n = unknown
  misc_feature (190)..(190): n = unknown
  misc_feature (284)..(284): n = unknown
  misc_feature (336)..(336): n = unknown
  misc_feature (409)..(409): n = unknown
cctttttggaggatatatttgctaatggccnnttgntttatttgggggctcatttggagcaangaagtatggatcggtaatagcnccnttttaagctcattcataaatactggataattatttcattttttatcgcntttattattgaaatgcccacaacangnatncattcaaaatcaaactatatggnattagtagtatataaataattatttacttctactaattaatattggcgaattcatattctatttccatccctatcccttttttataaatcgtgnttcaataatttacctcaaaatgagatctaaaatatgaagaaatgatatacancttcatctatacttatattttaaaagtgcacaattaataataaaaagattattttactctcgtcttgagaatngagatttggtctttggcaatacacgtaacaatattctgaacttttcatagcttttaatataagtaaaag

SEQ ID NO: 1419 - DNA, 480 bp, Ctenocephalides felis
  misc_feature (25)..(25): n = unknown
  misc_feature (54)..(54): n = unknown
  misc_feature (474)..(474): n = unknown
tgaaatgtgaagacgacgtcaacgnatggtttgacccaaaatctttctcgtgcngaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgtattttatgtaaggagcacaaacaaaatgtcattaactatagtaatttctgatatttaaaatatataaatatagaagctttatgnccttta

SEQ ID NO: 1420 - DNA, 498 bp, Ctenocephalides felis
  misc_feature (391)..(391): n = unknown
tgaaatgtgaagacgacgtcaacgaatggtttgacccaaaatctttctcgtgcagaactgcatgcaaaagtgaaaacgtttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtnttttatgtaaggagcacaaacaaaatgtcattaactatagtaatttctgattatttaaaatatataaatatagaagctttatgaaaataaaaaaaaaaaaaaaaaaa

SEQ ID NO: 1421 - DNA, 311 bp, Ctenocephalides felis
  misc_feature (53)..(53): n = unknown
  misc_feature (56)..(56): n = unknown
ttttgtaagaccgccccgggcattttttataaataaacgtgatttgcctagcnttnttataaaatacagttcaacaattccttatcttatcagtgctttctaaaataacatacataatttaaatcaaaattaaatacgagtaacaaaagtagtaaacaaatagaattagttctaatcttcttacacctaaaaactattttagataaattgagtagatcgccattttcttttaatttaataaattcttttttatgatgtattaaatattcatatatcgtttatttaaatgtttccggtatcttataatttgt

SEQ ID NO: 1422 - DNA, 318 bp, Ctenocephalides felis
  misc_feature (23)..(23): n = unknown
  misc_feature (54)..(54): n = unknown
cctacacaactcagggcaatggntttttgtatatctttaatgatgggtcgatgnggaagtgttgttggaagcaatgttgtaggaataattctacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgtactattcgtagtatcaatgaagtcgccgcccaagcattgatgaattttggacaacgtagcatattgt

SEQ ID NO: 1423 - DNA, 498 bp, Ctenocephalides felis
  misc_feature (58)..(58): n = unknown
  misc_feature (453)..(453): n = unknown
tatttttgcaataaaaaccagtaaccagtggcacacaaatttgtaatgggcatgtttnattatgatcgatcgtattttatattaagagcaattacattattaattaagatattacattctcttgaattacttcttattctttggaacctctaaaagttcttccagtagttcatccatagcttctatcaagctagtacgataattttcattgttctccatgagatccaaaacagtctgctttctcattccattaacagtacgatcaaactcctcagaatcgtgacttaaaactgccagaatttctggaggcatttgagtaagaggcaatgtcatcaccgccaaaattttagcgcacaaacgcaaatcatctgtgctatcatcaaactcttgtcaggaattatatcatttacatccaaattgccttcgtaatggtttctacaaatgctgctctgnagaaccttttcaattcctcatagtgtggctctgaactctggatgt

SEQ ID NO: 1424 - DNA, 498 bp, Ctenocephalides felis
gaattaaggatttcaatttacctcaactgcaagtgttggatttaagcgagtgccagttttctcttatagatgctgatatgttcagaggaattggatctcttagcagtttgaatctcagtagtaatggaatagtagaaatctatccaagagctttcgataatttgattgacttgagatttattgacttgacacataatctacttactttcttacctgacaacgtcttccaaaataatgatcatttggatgttattaaaatttctaacaacccgaatctcatgaatttgcctagatttcattcaaatttgtcatcgtttaccacttatatgtttgaagcagtaaattgcggattacttagcttagacaaacatacatttgctgaaatgccttccatggctcaactgaatttagctcagaactcgatcaaagatttaaaatataatattttctggcatatgcgcaatttaatcagcttagatttgagtaataataaaatca

SEQ ID NO: 1425 - DNA, 269 bp, Ctenocephalides felis; identical to SEQ ID NO: 441

SEQ ID NO: 1426 - DNA, 313 bp, Ctenocephalides felis
  misc_feature (63)..(63): n = unknown
aattcttggctataagttcgttgcatgttttgcaagtgatttgtttattgcatttattcccgnggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 1427 - DNA, 206 bp, Ctenocephalides felis
  misc_feature (37)..(39): n = unknown
  misc_feature (64)..(64): n = unknown
gccagttaatgatctacaacttgttcaaaaagccttnnntgatggatcgaacgcgtgtggaagntcaatcgaatccttcctaaatgttattgaaactgaagaagcacctccaacctttaatagaactaacaaattcactcaaggtttccaaaacttgatagatgcctacggagttgctagttacagagaagtaaatccagctctgt

SEQ ID NO: 1428 - DNA, 250 bp, Ctenocephalides felis
  misc_feature (32)..(32): n = unknown
  misc_feature (67)..(67): n = unknown
  misc_feature (207)..(207): n = unknown
  misc_feature (217)..(217): n = unknown
  misc_feature (225)..(225): n = unknown
  misc_feature (227)..(227): n = unknown
tttttttttttttttttttttacttttaattntattttcttcacggggggtattaactctatatctntatctatctatctattagctcaaccaataaaattaagcgtaaaatgaataattttgattagaacaaatatattcatggatttaaaaaaatctaaattgtaaaattcttaaatgccttatcatatttgcgagcctgtgttnaaccataatntttttttntntaacacataaagtaaaacaaagt

SEQ ID NO: 1429 - DNA, 220 bp, Ctenocephalides felis
  misc_feature (24)..(24): n = unknown
ttctcaagtgcaacccaatacatnaggtaaccgctaacagaagttatcacagtgacgttctacatcggagaatggttagaattcagaaaataatcatgcaacacggtctcattattataacattcacataaaaaatatttaaaatatgtaaactagcttgcatgtttattgtaagccagtctataatctattattgtttgcactttacttaaatttaagt

SEQ ID NO: 1430 - DNA, 498 bp, Ctenocephalides felis
  misc_feature (29)..(29): n = unknown
  misc_feature (59)..(59): n = unknown
  misc_feature (206)..(206): n = unknown
  misc_feature (239)..(239): n = unknown
atcaaaataattcagagccccgcaaagtnagagctctatatgactttgaagcagcagangataacgaattgaccttcttagctggtgaaataatccatatgctagatgattcacatcctaattggtggaaaggatataatcaacatggagaaggtttatttcctgcaaactttgtaactgctgatttatcagttgaaccagaacantttagaattgatgctaacaagaaatctgttcanttttctgatgctgttcaagtcaaaactatatctcatgatgatgaaaccagtcctgaaattaatgaagaaagtatagatactttattaaatttattacatgaagcaaatcctgaagatcctaatgatgatacagagcaaatgctcaacttagaagttcaagtaaataaaatgggccctctgattgatgctgaattagaaaatattgacaggaaacatgctcaacttacgcaattgagtggcgattagtagaagcacttaa

SEQ ID NO: 1431 - DNA, 273 bp, Ctenocephalides felis
  misc_feature (193)..(193): n = unknown
tactcctggtgcgggctcatccaatgatgcaaatacttctttatttactgttaaaggcgttccgtcgacattaaactcaccatcataagcggtaacgacagataacgccacaaaactaataaaaaagtaaaatttagttgcgtgaattcgtgcagttcacccgaaatgcagtattgtccggaaataggagcanatccggttaaggaatcctgtagcccacatcaagtgtgcgctgatcaaagtggatatctacagtgcaccactaaagaaagt

SEQ ID NO: 1432 - DNA, 406 bp, Ctenocephalides felis
  misc_feature (34)..(35): n = unknown
  misc_feature (65)..(65): n = unknown
  misc_feature (350)..(350): n = unknown
aatttatgacaatattatacaatggacacatttnnaaagtataatgaatgtattaaaatataaantaaagtgcgtttttactatttttattttttatgtaaaaatatttaataaattattaagtatttttataaagattattgtatgtttggattcatgagcaataagttctaatatagttcttaaccatacagtcactacatagcctaaatcgtccttttgacaaaataatactttcacaaacacttttcacaaaattcttacgagtcagttttattcgaagtgtcgctgttcttacgaataatatctacattgttcgcctttttttcttggcgcctagtataagccanatcacttgttggaattgaatttttagtgataacaatacgaggtttttctgcattgg

SEQ ID NO: 1433 - DNA, 498 bp, Ctenocephalides felis
  misc_feature (30)..(30): n = unknown
  misc_feature (34)..(35): n = unknown
  misc_feature (63)..(63): n = unknown
aataaatcatggtctgaagagacaaataanattnnaagtcaaataataccttgtcagcatggntatgaatatgacagaacatggtatttatcaacggctccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgtcaccggaagactaattacagcatttacttccagttggtttattgtttttataacagcggcttttcttggttcactaacatctacatctgtttttcaaagccctttgataattgcgatggaaatatccagaagtgaagatagagcacacattgccatgatgcagtccatcgggtggccagtggaatgattcttatgccgtactgatgtgggcgacgcgagatggtttatcttgctttggtag

SEQ ID NO: 1434 - DNA, 174 bp, Ctenocephalides felis
  misc_feature (94)..(94): n = unknown
  misc_feature (121)..(121): n = unknown
cgaaacccgagcaaaaatgtaaaaaagtaaaatttatttgcgtgaattcgtgcagttcacccgaaatgcaagtattgtccggaaataggagcanatccggttaaggaatcctgtagcccanatcaagtgtgcgctgatcaaagtggatatctacagtgcaccactaaagaaagt

SEQ ID NO: 1435 - DNA, 204 bp, Ctenocephalides felis
  misc_feature (31)..(32): n = unknown
cagttaatgatctacaacttgttcaaaaagnnttaactgatggatcgaacgcgtgtggaaggtcaatcgaatccttcctaaatgttattgaaactgaagaagcacctccaacctttaatagaactaacaaattcactcaaggtttccaaaacttgatagatgcctacggagttgctagttacagagaagtaaatccagctctgt

SEQ ID NO: 1436 - DNA, 498 bp, Ctenocephalides felis
  misc_feature (27)..(28): n = unknown
  misc_feature (493)..(493): n = unknown
gggtatctggcgtcatatgtggttccnnagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctccatattgctcacgttcaaaattaatgtaaaatacgtcacggacatacaatccacaaagcacaataagtgtagtatttctagctaaacgtaaactagaaaataaactcatgattccgnaacct

SEQ ID NO: 1437 - DNA, 457 bp, Ctenocephalides felis
  misc_feature (94)..(94): n = unknown
  misc_feature (142)..(142): n = unknown
  misc_feature (350)..(350): n = unknown
aatttcataaagcctgtatatttatatattttaaataatcagaaattactatagttaatgacattttgtttgtgctccttacataaaatacaantttatacattttaatttttatacatattttttatatttaattgcacanatcatttgtgtatttattatattaattgactactttatgataatttgaatcctaattagtctattcaagattgttttcctggtttaagccttacttagcaatctcacttttgcattcttcgcgggtggcgtgggtatgcatcgcaactccgttttatcaaagtgcaagccatttggacaatcataatgttttatttgccatttgttgntaaccaagaaacattgataatattttttacaatctcttcgatcggaaaaaacgttttcacttttgcatgcagtctgcacgagaaagattttgggcaaaccattcgtg

SEQ ID NO: 1438 - DNA, 498 bp, Ctenocephalides felis
  misc_feature (33)..(34): n = unknown
  misc_feature (59)..(59): n = unknown
  misc_feature (328)..(328): n = unknown
tttatcaaaaatcctagtttatgagtagtgtgnngccagaaggccgtaaggtcgtgaangatctgaacgtccatcaacatcttcaatggatgaaatcgtcgcctaagtcaagaaatggtgttggtaaactaccatttaggttcagtcaagttagtttttgaccttaacatatctaacaaatcaattataccatcaaattgggcatgagacgctttgctgttcatctctaccatcattgttgaactcccttcacacaacgcctatattgtgaacgcttttttggccataaactcatgaaatatcatgggacaaccaacgtattcactanatctatccttctgtaaattatttattgcatggatacttaagtatagaattacaagtaatactattgttagatacctctttggatcgatagattccactaacaatgtttgtaagaaaaaaacgccaaaggagctgaagaatatccttataaaggcgtttaaaagatgcttg

SEQ ID NO: 1439 - DNA, 388 bp, Ctenocephalides felis
  misc_feature (38)..(38): n = unknown
  misc_feature (45)..(45): n = unknown
  misc_feature (49)..(49): n = unknown
  misc_feature (109)..(109): n = unknown
  misc_feature (166)..(166): n = unknown
  misc_feature (170)..(170): n = unknown
  misc_feature (299)..(299): n = unknown
tttttttttttttttttttttttgaaggaatgcagtanataaccnttanttatggatgcatagataaatgtgtgtcaaatttaaaacactattgtaaatttaatatatnttctatattcacattttcattatatttctaatctaatatccccaaatttcaactaanaagntaaatcctttgccagtctgagaagataggagtaaagttacatttttccagccaaccccaccattgacaagagtggcatagcctccttggcatttacatattggtccagggcacgtacacaactgattgngcgattatttcttgaacccactggtggaaatgacacttctctggtagctttcctgaaaaagcttccacttttggattggacttgtcggt

SEQ ID NO: 1440 - DNA, 283 bp, Ctenocephalides felis
  misc_feature (35)..(35): n = unknown
  misc_feature (38)..(38): n = unknown
ctgctgctttctgctagtgaggtatttgctgcttntantggagtatttgttgaagtattttggcttaagggttgtgattcggtgaggtttccattgctttcattcacgtttgaacttggagcagttgtggatgggcttatttcatcattcgttgactgtggttggtcgtctttaacgtcactgtctgggaaagcaatagtaaaagtatgattatgagtgaatatttatttgctcgactattattatcttactaagcaaacgcctgggcccagggtcagtctgt

SEQ ID NO: 1441 - DNA, 500 bp, Ctenocephalides felis
  misc_feature (27)..(27): n = unknown
  misc_feature (30)..(30): n = unknown
  misc_feature (33)..(33): n = unknown
  misc_feature (54)..(54): n = unknown
  misc_feature (85)..(85): n = unknown
  misc_feature (137)..(137): n = unknown
  misc_feature (163)..(163): n = unknown
  misc_feature (212)..(212): n = unknown
  misc_feature (425)..(425): n = unknown
  misc_feature (428)..(428): n = unknown
  misc_feature (499)..(499): n = unknown
ttttttttttttttttttttttttttntgnggnaaacaaattcatttaattggnggaacggttgaatgttttatctaaatagtanaatcttaattctctattacgtgtacatttattacgtgtatgtatcggaatgnttatgcaacttgccttaaggcaaagngctacttacaactatagttaacattcattttggcatttatattttctgngacaatccaaaataatacttaaattatttctatcatgatatatgatacgcgtgataaaattcacataatctatattattttgctattaatattaacttaattcttaaatttatttcttatttttcatttttaaccacgccatctcggcaagccatggtatacagcaaatgagtaaacacacagtcaaggcatggaaacatattatgtagctgnggntgcatctcgaataaacccaacgattggcccaaagccaatgcattattccttgcaagaacatgaacagccgna

SEQ ID NO: 1442 - DNA, 476 bp, Ctenocephalides felis
  misc_feature (62)..(62): n = unknown
  misc_feature (81)..(82): n = unknown
  misc_feature (84)..(84): n = unknown
  misc_feature (109)..(109): n = unknown
  misc_feature (132)..(132): n = unknown
  misc_feature (334)..(334): n = unknown
tttttgagatatatttgctaatgtccatttgctttatttgtgggctcatttgaagcaaaaantatggatcgttaatagcanncnttttaagctcattcataaatactgnataattatttcattttttatcgntttttattattgaaatgcccacaacaagtatacattcaaaatcaaactatatggtattagtagtatataaataattatttacttctactaattaatattgtcgaattcatattctatttccatccctatcccttttttataaatcgtgtttcaataatttacctcaaaatgagatctaaaatatgaagaaatgatatacaanttcatctatacttatattttaaaagtgcacaattaataataaaaagattattttactctcgttcttgagaattgagatttggtctttggcaatacacgtaacaatattctgaacttttcatagcttttaatataagtaaaag

SEQ ID NO: 1443 - DNA, 498 bp, Ctenocephalides felis
  misc_feature (37)..(38): n = unknown
  misc_feature (62)..(62): n = unknown
  misc_feature (66)..(67): n = unknown
  misc_feature (283)..(283): n = unknown
  misc_feature (346)..(346): n = unknown
tgaaatgtgaagacgacgtcaacgaatggtttgaccnnaaatctttctcgtgcagaactgcntgcnnaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactanttaggattcaaattatcataaagtagtcaattaatataataaatacacaaatgatctgtgcanttaaatataaaaaatatgtataaaaattaaaatgtataaaattgtttttatgtaaggagcacaaacaaaatgcattaactatagtaatttctgattatttaaaatatataaatatagaagctttatgaaattaaaaaaaaaaaaaaaaaaaa

SEQ ID NO: 1444 - DNA, 358 bp, Ctenocephalides felis
  misc_feature (40)..(40): n = unknown
  misc_feature (106)..(106): n = unknown
  misc_feature (115)..(115): n = unknown
  misc_feature (141)..(141): n = unknown
  misc_feature (247)..(247): n = unknown
  misc_feature (320)..(320): n = unknown
  misc_feature (333)..(333): n = unknown
atctgaaagcaacacatctcatgtaagggtactttattgnaaaagttattttatatgtaatttttaataacattaaaattatttagttctttctgttagatgaatngtgtgttanatcttgtgctgtgatttacatacaanttaatacagattgaaatgcaatctataaaagcattatttcaataatcattatatagtaattttgattttgactatttgcagataaattcattacattttaaaatgnttactttattaagctatacaaaccttgaactttacactttgtatttctagaacataagtattaaataaattgntaaaaatatttgnggctagattttcctattgctaattg

SEQ ID NO: 1445 - DNA, 443 bp, Ctenocephalides felis
  misc_feature (24)..(24): n = unknown
  misc_feature (350)..(350): n = unknown
  misc_feature (392)..(392): n = unknown
  misc_feature (394)..(394): n = unknown
  misc_feature (440)..(440): n = unknown
gggaatgcatttgaaactatagtnccaatggaaattcctgtctgcctcaaacaggttggatatgtttccattgcttgcagattcacaacataaaacgtgatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaaataatgnaaaatacgtcacggacatacaatccagcaaagcacaataagngnagtatttctagctaaacgtaactagaaaataaactcatgattccgnaac

SEQ ID NO: 1446 - DNA, 415 bp, Ctenocephalides felis
  misc_feature (30)..(31): n = unknown
  misc_feature (103)..(103): n = unknown
  misc_feature (263)..(263): n = unknown
  misc_feature (273)..(273): n = unknown
taacctctaatgacgtcttaacacgtaagnnaaggcaagcagatgatgctccaaaagaacccgatttcaacctagctaaagaatacaacgactcctacccggnggtttttaacatcattttatggttcggagtagcctttttcttctcgttacttgctatctgtatctcgatctccacaatggaccctggcagggactccattatttacagaatgacatccacacgcatcaagaaggagaattaaagtttgcgaaaggagtgnttttaattgnaaatagattggttagtattattacaatgtaacgaggtattaatttgtgatcaatataaattaaaattaaaatcaatatctttggtgaaatcgaaatattggtctattatatttttggttacattcctagtattaccgaattg

SEQ ID NO: 1447 - DNA, 419 bp, Ctenocephalides felis
  misc_feature (28)..(28): n = unknown
  misc_feature (58)..(58): n = unknown
  misc_feature (94)..(94): n = unknown
  misc_feature (158)..(158): n = unknown
  misc_feature (258)..(258): n = unknown
  misc_feature (297)..(297): n = unknown
  misc_feature (348)..(348): n = unknown
  misc_feature (411)..(411): n = unknown
cgatcggttgcaatttgtcattgcaccnttcataaattgatgggtccggtgcataggntataaaagaattgggatttgggcatttcatgacggngcaatcagcttctgacgatttctttttacacatatttttagaatgatcatatacatagttaggngggcattcgaaaacctgcctttaccatctttgcagaataagtatcttgtgcagtctttcggatctggctgatatcctacaaccgcgcatgtagtttctgncgtcttacagttttccccaggttttgatgagcacatatnatctacacaaaatggagcatcggaatttgagtctctgcaattgattggtgnaattgggggttcttgtcagcgccaacttcaaagtagaacaatcgtgacaaaatgttccactgnttattaat

SEQ ID NO: 1448 - DNA, 318 bp, Ctenocephalides felis
  misc_feature (1)..(1): n = unknown
  misc_feature (18)..(18): n = unknown
  misc_feature (24)..(24): n = unknown
  misc_feature (26)..(26): n = unknown
  misc_feature (67)..(67): n = unknown
  misc_feature (87)..(88): n = unknown
  misc_feature (132)..(132): n = unknown
  misc_feature (203)..(203): n = unknown
  misc_feature (208)..(208): n = unknown
  misc_feature (212)..(212): n = unknown
  misc_feature (228)..(228): n = unknown
  misc_feature (243)..(243): n = unknown
  misc_feature (276)..(276): n = unknown
  misc_feature (278)..(278): n = unknown
  misc_feature (286)..(286): n = unknown
ntttttttttggtttttnggcccnancgatttatttttattaaaaagaaacatggtaattgcagggnagcttctatatttatatatnncaaaaaatcagaaattactatagttaaatgacattttggtttgngctccttacataaaaaacaattttatacattttaatttttatccatattttttatatttaattgcacagancattngggnatttattatattaatngactactttatgatnatttgaatcctaattaggtctattcaagatggntntcctgggntaaagccttacttagcaatctcacttttgcat

SEQ ID NO: 1449 - DNA, 338 bp, Ctenocephalides felis
  misc_feature (26)..(26): n = unknown
  misc_feature (79)..(79): n = unknown
  misc_feature (85)..(85): n = unknown
  misc_feature (90)..(90): n = unknown
  misc_feature (289)..(289): n = unknown
  misc_feature (319)..(319): n = unknown
  misc_feature (331)..(331): n = unknown
  misc_feature (333)..(333): n = unknown
acgggagaaactacatgcgcgggtgnaggatatcagccagatccgaaagactgccaagatcttattctgcaaagatggnaaaggncaggntttcgaatgccccctaactatgtatatgatcattctaaaaatatgtgtaaaaagaaatcgcagaagctgattgcccgcatgaaatgcacaaatccaattcttttattacctatgcccggcccatcaatttatgcttggtgcaatgacaattgcacccgtcgtttttatataagaaactatttattatttttagaattgnaaaaaatagcactatttattttattatggngaatttatttgngntgtta

SEQ ID NO: 1450 - DNA, 411 bp, Ctenocephalides felis
ctttttcatcgtgcttttgtcaaaccccaacctaaagctgtgactgattccttgcctaccaatgcttcttttcgcctgggaatcggttttactaaattattgaattggatttcttcgtccacttcaataagcccaatatcggcgtatacggttttaggattatactcttcatgtacaatatattttttgacatcatagtaacgacctcctttgtttagtttgttggatccgacgtagatggaactcaaacggcctgcgactagacaatgtgcagcagtaagaacccatttttcattaagaatcgatccaccacaaaaatgtttcaagaatttatctcttaaagatacttgaaatggagcagaaccaggagcggcgtctgcacctccaacaattctggtgtggcattggagt

SEQ ID NO: 1451 - DNA, 498 bp, Ctenocephalides felis
  misc_feature (27)..(27): n = unknown
  misc_feature (58)..(58): n = unknown
aataaatataattttattatataaganacatatgtataacaatacaaattataactanttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagtacagcgtacgggtatctggcgtcatatgtggttccctgtgatgaaacgaaaatatttaaatcaggtttctgctgtttactcggcatagctcaatgtcacttgcatgataataccggtgcttgcctttttttacataaaatgatagtttttaaatagagtatatttgatgactacaaaggcgaaatggaatagaaatcgtggtcatatgatgaaaacattggggtaattcatcaaagatataaaacat

SEQ ID NO: 1452 - DNA, 500 bp, Ctenocephalides felis
  misc_feature (161)..(161): n = unknown
  misc_feature (407)..(407): n = unknown
cctgcaaaatggtaggactgctcaatattgttttattagcttttgcatctgttaacttttctttgtaattctcaattctccataccatgtgccccgttccattaaccggttcactcaaagccttatggaaggcccttgcatcttctgcatcttttatctgntgtgacaattgcgccaccaatctctcttgtttaaccaattgccgacttaatttatccaaaatatctgtattatcttgaactgtgcttttcatagatttcaattcgtataaaaaagaagctattcgagctttttgtttgtccaactcgtctgccgttttcgtatgatcttcataaaagttggaagccacttctcgtctcgttttttgggcatctttttgtaattgtattactgattgcgtatgaganccatgtcttgtctaactcatttactcttgcgaagtttttatcctgccgttaatacgacctcgacttgggttcttggtttcttcatctagtatc

SEQ ID NO: 1453 - DNA, 251 bp, Ctenocephalides felis
  misc_feature (2)..(2): n = unknown
cnaataaatatattttttttttttaagaaacatatgtttaacaatcaaattataactatttaacagtcttcttgtgataatttcttgcggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagt

SEQ ID NO: 1454 - DNA, 383 bp, Ctenocephalides felis
acaacaaacatctggataaaatcaacgttatcaaaattaacaacaaattaattaaaatattggaatgtagttgtcaatcttggtcctgtgcttttgagcaacgcactcacttatccaaacaatgttacggcactcttgttccttgagtttcaaataagagtaaaagactccgaaatgggattgttgcaagaaagcaaacacattgagatgaacctcatgttcaaagaatttatcttcaagtgttttgtcgccggtccatcgccagagccttcgaataaagcagaatactcagcataatattcagctcagctttaacttgtcataatcatcagcacgagccagagcagctaaaccgtctgggtttagtttaccacaacgggggt

SEQ ID NO: 1455 - DNA, 304 bp, Ctenocephalides felis
caacttttaatgatattcaacttcaaactcacgtggctaatattttccaagttgatagaagtaaaattaaaataactcatacacctgaaacttcagtaactattctctcttgatttcagtattaaaatataataacaaaaagtgataatgtaattttgttcatgagtttttgctgaaatgatctgaatatttacctgttttcgaattaccaaacattgaaaagttaaaaataaaaaatatttattactttaatttattttagcatatgaacaattcatattgttaacttataataaataatagt

SEQ ID NO: 1456 - DNA, 498 bp, Ctenocephalides felis
  misc_feature (85)..(85): n = unknown
  misc_feature (396)..(396): n = unknown
aaactacaaactacaaaataattaagatcattatatgaatcacataattgtataactaaaaactgcattttatcataaaaattgntataatttttttttataaataataattattattattatcctgaaaaattttgagaattgacaatttccatacattatgccactgaatcataccgaattctgtcaaaatatcatgtatttgctgtgcattcaggcgttttacacataaactgcaaccgtcaatcgtatgttatgaagctgagtcagaaagaccatgttatataacatcgttttttgacgtttgtgtggtttctgggtttttatgtgataacttgagaaatcgcctgactgcagagcaaccgcatggcttttgcaatattcagtatggaaagntgtcgtatcatagccttgcataacataagtctgttatgcggccgaatcggccattaatattaaattttgatgtgatttttagaataaaatatgctcagtgtt

SEQ ID NO: 1457 - DNA, 466 bp, Ctenocephalides felis
aactttgtcttttaccaaaagtccttacatcaactcggtatactcataatttaataatttttaattgatgtcgaccctacgttgtcgcaatgtttactaactttcaaattcttgtaacttttaaactgtttgtttaatttaaatgaaatatttggcaaatttgttcaaaattaaatagtctataactttttctaacatcctaagtccatagagcaactcggtatactgaaaaattaataattttaaattgatgtcgacactacgttgtcgcaatgtttattaactttaaaattcttgtaacttttgaatggtttgtttaatttgaatgaaatatttggcaaatttgtttgaaattaaataatttacaactttgctaacatcttaagtccatagagcaactcggtatactcataaattaataatttctgattgatttcctgaaagatttactttgtaattggtgaag

SEQ ID NO: 1458 - DNA, 92 bp, Ctenocephalides felis; identical to SEQ ID NO: 1198

SEQ ID NO: 1459 - DNA, 498 bp, Ctenocephalides felis
gggtatctggcgtcatatgtggttcccaagtatacaatgtatgggcctaatactcctaatgcatttgaaactatagttccaatggaaattcctgtctgcctcaaacaggttggatatgtttccattgcttgcagattcacaacataaaacgtaatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatcgtcacggaacatacaatccagcaaagcacaataagtgtagtatttctagctaaacgtaaactagaaaataaactcatgattccgtaaa

SEQ ID NO: 1460 - DNA, 419 bp, Ctenocephalides felis
taacctctaatgacgtcttaacacgtaagacaaggcaagcagatgatgctccaaaagaacccgatttcaacctagctaaagaatacaacgactcctacccggtggtttttaacatcattttatggttcggagtagcctttttcttctcgttacttgctatctgtatctcgatctccacaatggaccctggcagggactccattatttacagaatgacatccacacgcatcaagaaggagaattaaagtttgcgaaaggagtgtttttaattgtaaatagattgtttagtattattacaatgtaaccgagttattaatttgtgatcaatataaattaaaattaaaatacaatatctttgttgaaatcgaattattgttctattatatttttgttttacattcctagtattaccgaattgt

SEQ ID NO: 1461 - DNA, 493 bp, Ctenocephalides felis
  misc_feature (28)..(28): n = unknown
  misc_feature (31)..(31): n = unknown
tttttttttttttttaatttcataaagnttntatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggcaaaccattcgtgacgtcgcttcacatttcag

SEQ ID NO: 1462 - DNA, 500 bp, Ctenocephalides felis
  misc_feature (79)..(79): n = unknown
  misc_feature (81)..(81): n = unknown
  misc_feature (93)..(93): n = unknown
  misc_feature (107)..(107): n = unknown
  misc_feature (118)..(118): n = unknown
  misc_feature (181)..(181): n = unknown
  misc_feature (196)..(197): n = unknown
  misc_feature (209)..(209): n = unknown
  misc_feature (236)..(236): n = unknown
  misc_feature (239)..(239): n = unknown
  misc_feature (334)..(334): n = unknown
  misc_feature (339)..(339): n = unknown
  misc_feature (415)..(415): n = unknown
tttttttttttttttttttttttttttcggcccaaacgatttatttttattaaaaagatacatgtaatttcataaagcntntatatttatatnttttaaataatcanaaattactatngttaaagacattttgtttgggctccttacataaaaaacaattttatacattttaatttttatncatattttttatatnnaattgcacagancatttggggatttattatattaattgnctnctttatgataatttgaatcctaattagtctattcaagattgttttcctggtttaagccttacttagcaatctcacttttgcatttttcgccgggnggcgngggtatgcatcgcaactccgttttatcaaagtgcaagccatttggacaatcataatggtttatttgccatttgtgntaaccaagaaacattgataatattttttacaatctcttcgatcggaaaaaacgtttcacttttgcatgcagtctgacgagaaaga

SEQ ID NO: 1463 - DNA, 207 bp, Ctenocephalides felis
  misc_feature (8)..(8): n = unknown
  misc_feature (30)..(30): n = unknown
  misc_feature (43)..(43): n = unknown
  misc_feature (116)..(116): n = unknown
  misc_feature (119)..(119): n = unknown
  misc_feature (127)..(127): n = unknown
  misc_feature (172)..(172): n = unknown
aaagaggnttcaggaagctcttcttcgtcncctgattttggancccgagttggttcaaccaattcaccaggatcgtgaatctaatgaacatgaagaacaattcaacaagcaccatnatnacaagcancacaaagctgattatatgaatcacatgagagtcaccgacacttcngcaatcatggctggttcttttgctgtgatagcggt

SEQ ID NO: 1464 - DNA, 332 bp, Ctenocephalides felis
  misc_feature (21)..(21): n = unknown
  misc_feature (50)..(50): n = unknown
  misc_feature (301)..(301): n = unknown
  misc_feature (307)..(307): n = unknown
  misc_feature (310)..(311): n = unknown
  misc_feature (315)..(315): n = unknown
  misc_feature (317)..(317): n = unknown
  misc_feature (324)..(324): n = unknown
ttttgttttactttatgtggntatataaaaaaatattatggttgaacacnggctcgcaaatatgataaggcatttaaagaattttacaatttagatttttttaaatccatgaatatatttgttctaatcaaaattattcattttacgcttaattttattggttgaactaatagatagatagataaagatatagagttaatataaaaatggagaaaataaaattaaaagtaagaaataatacggacttctaaatgtagggggaagtcccctagtggcggacacctaaagttatttataaatnactcanaanngaananaaaaaanaaaaaaaa

SEQ ID NO: 1465 - DNA, 423 bp, Ctenocephalides felis
  misc_feature (346)..(346): n = unknown
  misc_feature (349)..(349): n = unknown
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataaagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgntgnaattggggtttcttgtcagcgcacaacttcaaagtagaacaatcgtgacaaaatgttcccaactgcttattagt

SEQ ID NO: 1466 - DNA, 500 bp, Ctenocephalides felis
  misc_feature (489)..(489): n = unknown
caactctaagctttccaacatttgtattttattcaaataaatataaataaaaatcataattcgacaattttactcgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattattctataaccgaatttaacctaaaatacaagaaatacatattcataaatatacatatattttaatacaaaaaggtaacttgtgcaaaaatgaaattcaaatcacttggtttgctaatttaaatggttntagattttctc

SEQ ID NO: 1467 - DNA, 498 bp, Ctenocephalides felis
  misc_feature (157)..(157): n = unknown
  misc_feature (391)..(391): n = unknown
  misc_feature (434)..(434): n = unknown
  misc_feature (457)..(457): n = unknown
  misc_feature (480)..(481): n = unknown
atatatcttacatcgaatctaataacaataaagagttattaattttcatgtcgatgttttagaaaatgattcagtagcaacttctgaattttctttgtaattgataatactttcttaaagtataattgcatttcacaacacacgacggaaatatggntatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttcaacaacacttcctaatcgacccatcattaaagatatacatactgccattgcccttggttgtgagggtactcggncgcgatcgagcggccgccggcaggtacccaaggaagtcacaanagaatgggcaaggcttagctccncagcgatcaaagataagcctttnnattagtttaaactcaac

SEQ ID NO: 1468 - DNA, 126 bp, Ctenocephalides felis
cttattgttttatattagctttcttattactaatcaataaaactataaaatatgtaatactgccatttactttacaagaacctagcaggttagttaaaaattttctttactataagatgttggtgt

SEQ ID NO: 1469 - DNA, 435 bp, Ctenocephalides felis
  misc_feature (21)..(21): n = unknown
  misc_feature (36)..(36): n = unknown
  misc_feature (66)..(66): n = unknown
  misc_feature (117)..(117): n = unknown
  misc_feature (169)..(169): n = unknown
ccaacaatatcctatttttgnattaattgatatgcnttttaatttggctactaatacttctatganaattcattttttaaataagtggtttaaataaataatttcattgaaaagtcncatcaaaacttttctccaaatatagttctataatatttagtttttagcctgntatcactattagattaaattataaattgtttgtaattggctaattgtaaagtgtttataaatgaacttttgttgtcatttgttatgaagatatatgtattttgaagcatattttttgtaacattgtgcaaatgcttatttgtttggttgtaataggaaaataattatgattcttattactcattaaactataataaattttagtcccatgttaaacattacaattaagtatctatttagcaaaaaaaaaaaaaaaaaaaaaaaaaa

SEQ ID NO: 1470 - DNA, 498 bp, Ctenocephalides felis
  misc_feature (57)..(57): n = unknown
  misc_feature (142)..(142): n = unknown
  misc_feature (150)..(150): n = unknown
  misc_feature (202)..(202): n = unknown
  misc_feature (212)..(213): n = unknown
  misc_feature (217)..(217): n = unknown
  misc_feature (231)..(231): n = unknown
  misc_feature (259)..(259): n = unknown
  misc_feature (286)..(286): n = unknown
  misc_feature (328)..(328): n = unknown
  misc_feature (352)..(353): n = unknown
  misc_feature (370)..(371): n = unknown
  misc_feature (392)..(393): n = unknown
  misc_feature (411)..(411): n = unknown
  misc_feature (425)..(425): n = unknown
  misc_feature (427)..(427): n = unknown
  misc_feature (452)..(452): n = unknown
  misc_feature (456)..(456): n = unknown
  misc_feature (467)..(467): n = unknown
  misc_feature (481)..(481): n = unknown
aatttcacatcgaataatattattattcttacattctaccattccttggaatagggncacattcatttttagaaaaaaatataaatacaattccatttatcatgttgcaaatcttcaattttaaaaaaatattgatccgatncattttgngatgtttacccgtattagccgaagggaatattttgttggtttctggtgcggnaaaagaaaanntggnagattatttaattntctataaatttgccgaatatttcatttnaatcaaataaaccgttcaaaagttatnaataaatgcacttttcctaaactcaagaacaaaacagtgaancgctgtgaatatttatcaactttnnaacaaacttttttgagnntaccgagttgctgtagggctnnctatgttaggaaaatgtnttagactattcaantntctatattttctcccaacatatatntagnttccgcaaatnggtttaaggtatcncaatgtacgaataaatg

SEQ ID NO: 1471 - DNA, 468 bp, Ctenocephalides felis
  misc_feature (464)..(464): n = unknown
aactttgtcttttaccaaaagtccttacatcaactcggtatactcataatttaataatttttaattgatgtcgaccctacgttgtcgcaatgtttactaactttcaaattcttgtaacttttaaactgtttgtttaatttaaatgaaatatttggcaaatttgttcaaaattaaatagtctataactttttctaacatcctaagtccatagagcaactcggtatactgaaaaattaataattttaaattgatgtcgacactacgttgtcgcaatgtttactaactttaaaattcttgtaacttttgaatggtttgtttaatttgaatgaaatatttggcaaatttgtttgaaattaaataatttacaactttgtctaacatcttaagtccatagagcaactcggtatactcataaattaataatttctgattgatttcctgaaagatttactttgtaattggtnaaag

SEQ ID NO: 1472 - DNA, 498 bp, Ctenocephalides felis
  misc_feature (56)..(56): n = unknown
  misc_feature (388)..(388): n = unknown
ccaaatattgcagttcctacacgaacaatattgctgcccacttcaatcgcttgttnaaagtcatcagacattcccatagataaattaacttcttttggttctaaatttaattccttgcataattgctcacgacattgttttaaagtgagaaaatctgggttgggtcctaaacttgtatcatagccatattttccaatagtcattaaaccatcaacaagtaggtttgggcaattttctttcacatatttgtatagagttgttgcttcatttgggtgaacaccatgtttttctatttcaccacttgtatttatttgaatcataactcttaatttatcaccatgaattttattagctgaatctaattttgaccaagcattctgcacactgncggctaatttaaatgagtgaattgtttcgaccatatatatccaggttgttaaccccttattaattttatttctttgaagatgacctataaatgcattttatttctttaca

SEQ ID NO: 1473 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgcccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtttttatgtaaggagcacaaacaaaatgtcattaactatagtaatttctgattatttaaaatatataaatatagaagctttatgaaattcatgttctttttaataaaa

SEQ ID NO: 1474 - DNA, 498 bp, Ctenocephalides felis
  misc_feature (394)..(394): n = unknown
cagagtgaggggaggggacaagaagcctgaggcatcttcaacttcaaatggaagttcgtcccccctcaagagggtgggcaacccgttcagaacaccgttacagaaagcactgcttgagcagtggaacatgtctcgggaatctcaaagatacctttagcgaatacaatatctataactgtttgctaaaataacatttttatagacatccccctttaaaaatgataaggaaaataggttgcacacatattttctaatgcataaaaactgcaggattggttttcttttttatttaatttatttatgtgtgaagtatgaaacaatgcttattgctgtgcaacctctttggttatgtattgttaaatcataaaacgtaaagatctgatttttagtttgnttacattttgacaaacctgcattagaattgatttgcagtgagtaattttagagttgcatttaatttcattttaaaataataaagaaaaaatgctttacgatgca

SEQ ID NO: 1475 - DNA, 498 bp, Ctenocephalides felis
  misc_feature (57)..(57): n = unknown
  misc_feature (203)..(203): n = unknown
  misc_feature (440)..(440): n = unknown
ccatgacctcctgtgaaataacttacaggatacccaattgctatcaccaaccaggcnccaatcatcgaatagtacataaaaccaattcggtaaggtgcaataacttcatcatttgaatgcccatcgtgatgctgggtcttccatacagaattcacagtcgtatttttaccctcaggacaaccttcagtcgacatatttaggtnaggaaacttcaaattaccttgagcaatgttaatttgggctccacttaccatccaactgaccaggattagacttgctgcagctcccaccaaaactccctttgtgtttgctttagggaacaagattcccaatgtaaacattcccaaaagggttcctgcagtaactccagtgcactaatgaccaaatgcatgacgcttctaattgtctactacaaagacaaagtccgaggcaaattcctncaattactactacagcagcttcataatattactgcagcttctcactagtggtgactgg

SEQ ID NO: 1476 - DNA, 498 bp, Ctenocephalides felis
  misc_feature (182)..(182): n = unknown
  misc_feature (402)..(402): n = unknown
gggtatctggcgtcatatgtggttcccaagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggntaacagtgataccaaattctggagggattcatcattggcaatgcatataagaatggaagatgctgccagagcaattccaaaagaagctacagaggtccaacgtcttctattctgtcgctggagaaacgtcctagtagatatgctggtaattctactgccgattgatataaaaaggtgagaaatggattacctccatattgctcacgttcaaaattaatgnaaaatacgtcacgggacatacaatccacaaagccaataagtgtagtatttctagctaacgtaaactagaaaataactcatgatcccgaaacttttt

SEQ ID NO: 1477 - DNA, 118 bp, Ctenocephalides felis
catcaccgagaagaactcttcggctacggaatatcttcattggaggcgcgttgttggtgcacgcagcattaacaaggttcttgcaattcagcataatgaccagaagaaaaatacaggt

SEQ ID NO: 1478 - DNA, 399 bp, Ctenocephalides felis
  misc_feature (31)..(31): n = unknown
gttcttatttttattttcatattgggccccnaagggagatttatacttaaaacaataaaaaatgcgttttattaaaagttgcaagcagttaaataaaatgttgaataaataatagtgataaatcattgcataatgatgcaactcataattattaagtaaattgtctataacaactactacattatcagatctatccgtcacttcttaatattcaataatattatggatatcaggcctcttatcactttatagatttttaattaatctatttaatattaaataaaaaataaatttaaaaccattaaaccgatacattgcctttaaatgaaataaatcaccataacctttattaagcttgttgtaatatgcaatagcaatttcatatacacactcactagg

SEQ ID NO: 1479 - DNA, 467 bp, Ctenocephalides felis
  misc_feature (464)..(464): n = unknown
aactttgtcttttaccaaaagtccttacatcaactcggtatactcataatttaataatttttaattgatgtcgaccctacgttgtcgcaatgtttactaactttcaaattcttgtaacttttaaactgtttgtttaatttaaatgaaatatttggcaaatttgttcaaaattaaatagtctataactttttctaacatcctaagtccatagagcaactcggtatactgaaaaattaataattttaaattgatgtcgacactacgttgtcgcaatgtttactaactttaaaattcttgtaacttttgaatggtttgtttaatttgaatgaaatatttggcaaatttgtttgaaattaaataatttacaactttgtctaacatcttaagtcatagagcaactcggtatactcataaattaataatttctgattgatttcctgaaagatttactttgtaattgggtnaag

SEQ ID NO: 1480 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattcatgttctttttaataaa

SEQ ID NO: 1481 - DNA, 461 bp, Ctenocephalides felis
gagcgggcggcccggcagggtccaagttctatatcaatttttatataacaataatttgagacagcaaactgaatcctgtattgattttctttgtccttggtgcagtctgaattgcggattattatattcgctactgaaacatttgaaactgtgccatgctagatttacctttacatatgtgccattaacacaatgtgctagaatagatgtagctataaacgagttgtatgatggttcttatgttggggcacctcaagatttgctaggcccttctggatttgcattttcaaggaatggaccgactcgaagaactattgttacacatatattagtttgccgaccaagaagaagtaaacccagtttatcagaattcttggaattggatgaaaatgaatgcgacagccaaagaccttacattacaggtcacaatcgtctgtatcatcatacaataacatgcctac

SEQ ID NO: 1482 - DNA, 269 bp, Ctenocephalides felis; identical to SEQ ID NO: 441

SEQ ID NO: 1483 - DNA, 402 bp, Ctenocephalides felis
  misc_feature (17)..(17): n = unknown
  misc_feature (28)..(28): n = unknown
gagcgggcggcccggcngggaccaattncggtaatatgaggaatgttaaacaaatatgtaacaacaaagatattgtatttttaaataatattgatcacgttgcattgtaataatactaaacaatctatttacaattaaaaacactccttcacaaacttaattctccttcttgatacgtgtggatgtcattctgtaaataatggagtcccttcggggtccattgtggagatcgagatacagatagctagtagcgagaagaaaaaggctactccaaaccataagatgatgttaaaaaccaccgggtaggagtcgttgtattctttagctaggttgaaatcgggttcttttggggcatcatctgcttgccttgttttacgtgttaagacgtcattggaggttagt

SEQ ID NO: 1484 - DNA, 210 bp, Ctenocephalides felis
  misc_feature (30)..(31): n = unknown
  misc_feature (33)..(35): n = unknown
  misc_feature (49)..(49): n = unknown
  misc_feature (54)..(54): n = unknown
gagcgggcggcccggcagggaccaatcatnntnnntctagggtctaatnccttncattaaaccagcaaagccaagttttttggcagcgtcaatggctgttgctcctttgtcttgatttagcttggaaacaactgtgtctgcaggatgagaaactactgcacagaatacaccggcaatgtaaccagcagcaaaggtgacaaccaattgttc

SEQ ID NO: 1485 - DNA, 498 bp, Ctenocephalides felis
  misc_feature (59)..(59): n = unknown
  misc_feature (214)..(214): n = unknown
  misc_feature (216)..(216): n = unknown
  misc_feature (338)..(338): n = unknown
  misc_feature (366)..(366): n = unknown
  misc_feature (458)..(458): n = unknown
  misc_feature (461)..(461): n = unknown
attgtaaacttacggtagatcaacaaattaaattaaattaaaatcgctaaataatttgnaataaaatctataaatattcatatttcaaagctatctaaatattagtaaaattactaagctaataacttttacattattaaaataaatcacatatgataacatttccattcgaacgaaaatgcccctgatttacattttttattttcatttaggngnttaaaatgctattaaaatattcactattcattttcaaatgatatagtatttaatataaattatctaatcagtataaaaattgctcataaaattatttatttaattttatatttaaaacaacnacgcaaatgttaaattatagttcttccnaagcattattttatcagttacttgagcctgcattatagggtttattcaattattttataaaatttatattattaggtcacttaatgcagagntgnataaaaaaaacttactataaaatatttgggtgggtaa

SEQ ID NO: 1486 - DNA, 499 bp, Ctenocephalides felis
  misc_feature (360)..(360): n = unknown
  misc_feature (391)..(391): n = unknown
caaaaggagaagttctaaagacgatttaaattctacatgtacctagtgagtgtgttatatgaaattgctattgcatattacatacaagcttaataaaggttatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgctngcaacttttaataaaacgcattttttattgntttaagtataaatcttattagggcacaatatgaaaataaaaataagaactttatacaaaagcttttttatacaatatgctcttgcgctattaagttaagaaatttatt

SEQ ID NO: 1487 - DNA, 492 bp, Ctenocephalides felis
  misc_feature (89)..(89): n = unknown
  misc_feature (103)..(104): n = unknown
  misc_feature (205)..(205): n = unknown
agcgggccgcccggccgggaccaaccattcggtggaagaattatgtccgaaataaccgaatataaaatttatatttttctaaatgggtnctatatgaatgggnntttatataaaaattgtatacaatattttcataatagcctgatgaatattatattaggctgcgattaagcaaatcattttattcaatgcattcgaaaaccgngggcttttcatgtttaatctcgggaaatgaacgaaaagaagttcgatcgccagaagtttatataaacaaactattggcaatgctattttaggaggtatagttatattataattttttatgatttataacctcgacatatttcaattttacactaaaatttatatttcataatattataatttttagattgatataagaatgaaatgatacataaacactttctatgttcatgatatataaattattttatggaatataagtttttatacaaatcatataaaaatgat

SEQ ID NO: 1488 - DNA, 472 bp, Ctenocephalides felis
  misc_feature (101)..(101): n = unknown
  misc_feature (330)..(330): n = unknown
  misc_feature (363)..(363): n = unknown
  misc_feature (399)..(399): n = unknown
  misc_feature (414)..(414): n = unknown
tgaaatgtgaagacgacgtcaacgaatggtttgacccaaaatctttctcgtgcagaactgcatgcaaaagtgaaaacgttttttccgatcgaagagattgnaaaaaatattatcaatgtttcttggttaacaacaaatggcaaataaaacattatgattgtccaaatggcttgcactttgataaaacggagttgcgatgcatacccacgcccccggcgaagaatgcaaaagtgagattgctaagtaaggcttaaaccaggaaaacaatcttgaatagactaattaggattcaaattatcataaagtagtcaattaatataataaataccnaatgatctgtgccattaaatataaaaatatgtntaaaattaaaatgtataaattgtttttatgtaaggngcacaaaccaaatgncattactatagaatttctgttatttaaaatatataaatatagaagctttatgaaattt

SEQ ID NO: 1489 - DNA, 421 bp, Ctenocephalides felis
  misc_feature (345)..(345): n = unknown
  misc_feature (348)..(348): n = unknown
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataaagtatcttgtgcagtctttcggatctggctgatatcctacaaccgcgcatgtagtttctgccgcttacagttttccccaggttttgatgagcacatatcatctacacaaaatggagcatcggaatttgagtctctgcaattgattgntgnaattggggtttcttgccagcgcgcaacttcaaagtagaacaatcatgacaaaatgttccaactgcttattagt

SEQ ID NO: 1490 - DNA, 500 bp, Ctenocephalides felis
  misc_feature (145)..(145): n = unknown
  misc_feature (245)..(245): n = unknown
cctgaaatgtggaagacgacgtcaaccgaatggtttgacccaaaatctttctcgtgcagaactgctgcaaaagtgaaaacgttttttccgatcgaagagattgtaaaaaatattatcaatgtttcttggttaacaacaaatggcnaataaaacattatgattgtccaaatggcttgcactttgataaaacggagttgcgatgcatacccacgcccccggcgaagaatgcaaaagtgagattgctnagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtttttatgtaaggagcacaaacaaaatgtcattaactatagtaattctgattatttaaaatatataaatatagaagctttatgaaattacatgttcttttaataaaat

SEQ ID NO: 1491 - DNA, 498 bp, Ctenocephalides felis
  misc_feature (320)..(320): n = unknown
  misc_feature (344)..(344): n = unknown
  misc_feature (352)..(352): n = unknown
  misc_feature (402)..(402): n = unknown
  misc_feature (472)..(472): n = unknown
tagtctaaatgttttatttgtttctttctacagttaatcaatatttgacattttatattttaatattgaataatttaatttttattatttggctctcggataatcggtcaataaaaaaaaaaatatgaatgaatgatatttaacacgcatattattattatactatttgttctttgagtgtgtatgatgctccgtgttattattttgaactcgactccattcggagtctatgcaaaggcatatatatgtgagtgtgtgtaagaatatttttcaaagattatatttgctttactttttaatagataatattatatttttgntaatgttaatgactatattatggntattttgntctttttgagctctatttatgaaattttatgctgagacaaaattgccggnagtattaagtgtgcattcatgccataactcccaacttttggtagaataattcacaatttatgtcagaggnattatataggtgtaaacaatttaata

SEQ ID NO: 1492 - DNA, 498 bp, Ctenocephalides felis
  misc_feature (119)..(119): n = unknown
  misc_feature (329)..(329): n = unknown
  misc_feature (378)..(378): n = unknown
  misc_feature (401)..(401): n = unknown
  misc_feature (416)..(416): n = unknown
  misc_feature (477)..(477): n = unknown
  misc_feature (496)..(496): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgnttcttggttaacaacaaatggcaaataaaacattatgattgcccaatggcttgcactttgataaaacggagttgcgatgcatacccacgcccccggcgaagaatgcaaaagtgagattgctaagtaaggcttaaaccaggaaaacaatcttgaatagactaattaggattcaaattatcataaagtagtcaattaatataataaataccnaatgatctgtgccattaaatataaaaaatatgtataaaaattaaaatgnataaaattgtttttatgtaaggngcacaaaccaaatgncattaactatagtaatttctgatatttaaaatatataaatatagaagctttatgaaattcntgttctttttaataaaaanaa

SEQ ID NO: 1493 - DNA, 275 bp, Ctenocephalides felis
  misc_feature (27)..(27): n = unknown
  misc_feature (71)..(71): n = unknown
  misc_feature (89)..(89): n = unknown
  misc_feature (101)..(101): n = unknown
  misc_feature (143)..(143): n = unknown
  misc_feature (150)..(150): n = unknown
  misc_feature (165)..(165): n = unknown
  misc_feature (192)..(192): n = unknown
  misc_feature (204)..(204): n = unknown
  misc_feature (248)..(248): n = unknown
  misc_feature (253)..(253): n = unknown
gcagtcaactttagctaccgttaatgntagttgaaccgacaacctttttagctaagtcatcccaagtaggngctaaccttttacaatgnccacaccatggngcaaaaaacttgacaaaaggcacaccctttgaaatgccttgntcaaagnttgatcccacaagantaaagacaccttcttcttcattagtgnctggaatgcgantatcatctctatcttcatcatcaatttgggaagcaccatgtttnttctnaacaaaagcccttaattcttcg

SEQ ID NO: 1494 - DNA, 498 bp, Ctenocephalides felis
  misc_feature (13)..(13): n = unknown
  misc_feature (30)..(31): n = unknown
  misc_feature (84)..(84): n = unknown
  misc_feature (144)..(144): n = unknown
  misc_feature (167)..(167): n = unknown
  misc_feature (178)..(178): n = unknown
  misc_feature (208)..(208): n = unknown
  misc_feature (217)..(217): n = unknown
  misc_feature (233)..(233): n = unknown
  misc_feature (293)..(293): n = unknown
  misc_feature (301)..(301): n = unknown
  misc_feature (345)..(345): n = unknown
  misc_feature (386)..(386): n = unknown
  misc_feature (397)..(397): n = unknown
ataaagtatccgntcaatgggtaacatttnngcagcaaaccaataattagtaacatctagaaaaggagctgataatgacaaggntgctaaaaaacaggtatgtcttaaagcaactcttctacataatgcaggatcagtaactgncatcattctatatccggctctgntgtaatcccgncttaaattccaagataacgcattaaaatgnggaaattgncacgtatataaaaggnctcctaagataaatgctcctgccttaaattaccggaacaagcacccaacccattaggggngggattgnttcgacaattgatccaacccaagttttaaaatcttattcttttnattggagtatatacagatgtatataatattaaattagctgntcctaatctgntggtaaaccatttacccaaaatatacatacctatcccgtagatgcagcaccgtagcaaaacctacagcatgtaatggacttaaaatcccctgactaaactc

SEQ ID NO: 1495 - DNA, 498 bp, Ctenocephalides felis
  misc_feature (26)..(26): n = unknown
  misc_feature (30)..(30): n = unknown
  misc_feature (34)..(34): n = unknown
  misc_feature (50)..(50): n = unknown
  misc_feature (58)..(58): n = unknown
  misc_feature (165)..(165): n = unknown
  misc_feature (183)..(183): n = unknown
  misc_feature (186)..(186): n = unknown
  misc_feature (200)..(200): n = unknown
  misc_feature (240)..(240): n = unknown
  misc_feature (246)..(246): n = unknown
  misc_feature (432)..(432): n = unknown
  misc_feature (469)..(469): n = unknown
  misc_feature (471)..(471): n = unknown
taataagcagttgggaacattttgtnacgnttgntctactttgaagttgngcgctggncaagaaaccccaattacaacaatcaattgcagagactcaaattccgatgctccattttgtgtagatgatatgtgctcatcaaaacctggggaaaactgtaagacggnagaaactacatgcgcggntgnaggatatcagccanatccgaaagactgcacaagatcttattctgcaaagatggnaaaggncaggttttcgaatgcccacctaactatgtatatgatcattctaaaaatatgtgtaaaaagaaatcgtcagaagctgattgcaccgtcatgaaatgcacaaatcccaattcttttatacctatgcaccggacccatcaatttatgcttggtgcaatgacaaattgcaacccgatcgtactgaaatgngaagaccacgtcacgaatgggttgcccaaaatctttntngtgcagactggtgcaaaagtgaaaacg

SEQ ID NO: 1496 - DNA, 203 bp, Ctenocephalides felis
  misc_feature (22)..(22): n = unknown
  misc_feature (73)..(73): n = unknown
  misc_feature (159)..(159): n = unknown
taaatatccaagaacaaagccngtgattataaagaaccaaaactatttcatgagaagggtacttctccacagnattattatctatctcaagttttcttctggtcattatgctgaattgcaagaaccttgttaatgctgggtgcaccaacaacgcgcctncaatgaagatattccgtagccgaagagttcttctcagtgatggt

SEQ ID NO: 1497 - DNA, 498 bp, Ctenocephalides felis
  misc_feature (33)..(33): n = unknown
  misc_feature (64)..(64): n = unknown
  misc_feature (105)..(105): n = unknown
  misc_feature (349)..(349): n = unknown
  misc_feature (468)..(468): n = unknown
ctagtgagtgtgttatatgaaattgctattgcntattacatacaagcttaataaagggggtggngatttatttcatttaaaggcaatgtatcggtttaatggttntaaatttattttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcattttttattgntttaagtataaatcttattagggcacaatatgaaaataaaaataagaactttatacaaaagctttttttatacaatatgcttcttgcgctattaagttaagaaatttatttatgcttgnaaaaaaacaataaatgcttatttattaaaa

SEQ ID NO: 1498 - DNA, 341 bp, Ctenocephalides felis
  misc_feature (25)..(25): n = unknown
  misc_feature (42)..(42): n = unknown
  misc_feature (48)..(48): n = unknown
  misc_feature (58)..(58): n = unknown
  misc_feature (80)..(80): n = unknown
  misc_feature (107)..(107): n = unknown
  misc_feature (122)..(122): n = unknown
  misc_feature (145)..(145): n = unknown
  misc_feature (153)..(153): n = unknown
  misc_feature (155)..(155): n = unknown
  misc_feature (159)..(159): n = unknown
  misc_feature (222)..(222): n = unknown
  misc_feature (235)..(236): n = unknown
  misc_feature (277)..(277): n = unknown
  misc_feature (279)..(279): n = unknown
  misc_feature (316)..(316): n = unknown
atacaaaggggaaaggtcaaggctngtatagcttaataaagnaaacantttaaaatgnaatgaatttatctgcaaatagncaaaatcaaaattactatataatgatnattgaaataatgctnttatagattgcatttcaatctgnattaaatngnatgnaaatcacagcacaagatctaacacacaattcatctaacagaaagaacaaaataattttaatgntattaaaaagacnnataaaataacttttacaataaagtaaccttacatgagatgngntgatttcagatacttttcatacaacagtgctttctgnataaacaatataatataaataacgg

SEQ ID NO: 1499 - DNA, 446 bp, Ctenocephalides felis
  misc_feature (30)..(30): n = unknown
  misc_feature (331)..(331): n = unknown
  misc_feature (336)..(336): n = unknown
  misc_feature (371)..(371): n = unknown
  misc_feature (402)..(402): n = unknown
  misc_feature (412)..(412): n = unknown
  misc_feature (414)..(414): n = unknown
cccaataacatcaaacgtcgcctgtcaatnaaaaatatcaacagcatcacatctaagcttacctagatatactttcattattttgtaattactttttttctgtcgaattattatacaaatgtgaaaatttaatttaatgtatttaatataatattccgaatgttgccaatactcaaaagtttgaatagcactgttactgtgtgaatcgcctggtgaaaaaaactagaatttatttacaaaatggtctagtgcaaaatttagagacacgtaacttacaacagccccaaaagagcgctagagcaaaacaccacgcgatttatacagtaattgntctgngcattggtatctattggatgtgtgacttaaggtgnatacatggcttcataaggcaacaataaacangttatatcgntntgacaaaaaaaaaaaaaaaaaaaaaaaaaaaa

SEQ ID NO: 1500 - DNA, 306 bp, Ctenocephalides felis
  misc_feature (17)..(17): n = unknown
  misc_feature (68)..(68): n = unknown
  misc_feature (170)..(170): n = unknown
  misc_feature (225)..(225): n = unknown
  misc_feature (295)..(295): n = unknown
aaggaaaaattctagantataattgggatttaacatttttaatatcaggaacatctctgatagcatgnggagtgattgcattctttataccgaacatttatcagaagcaagtggatagaagaacgagcattgcttcatatggaccataaccatatttccgcgtgtgttgngaaatgcaattatactttgagaaagtattatcaattacaaagaaaattcagaagntgctactgaatcattttctaaaacatcgacatgaaaattaataactctttattggtattagattcgatgnaagatatatgt

SEQ ID NO: 1501 - DNA, 249 bp, Ctenocephalides felis
gcttctcacgctggtcaattaattaaataacaaaaacaaacaataataggataaactcacttaaatgcaaaatcagtgtaattaaatccatcgatcaatattaataataatatataataaaacacaacacataatcagataaaggacaattttgttaatcgagtagaaaattgaatcaattttctattccaacaatttatttttattatgtgttgtgtttttaattgttagtctttttgcacaaaaagt

SEQ ID NO: 1502 - DNA, 313 bp, Ctenocephalides felis
  misc_feature (34)..(34): n = unknown
  misc_feature (59)..(59): n = unknown
  misc_feature (285)..(285): n = unknown
aattcttggctataagttcgttgcatgttttgcnagtgatttgtttattgcatttattnccggggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggntagtcgagtcacaactttctttaaccgt

SEQ ID NO: 1503 - DNA, 375 bp, Ctenocephalides felis
  misc_feature (4)..(4): n = unknown
  misc_feature (23)..(23): n = unknown
  misc_feature (35)..(35): n = unknown
  misc_feature (55)..(55): n = unknown
  misc_feature (66)..(66): n = unknown
  misc_feature (151)..(151): n = unknown
  misc_feature (347)..(347): n = unknown
  misc_feature (364)..(366): n = unknown
ctgncaaagtccaatccaaaagngggagctttttnatgaaaggtactaaagaggngtcatttccancagtgggttcaagaaaaaatcgtacaatcagctgtgtcgtgccctagaccaatatgtaaatggccaaggaggctatgccactctngtcaatggtggagttggctggaaaaatgtaactttactcttatcttctcagactggcaaaggatttaacttcttagttgaaatttggggatattagattagagatttaataaaaatgttattatagaaaatatattaaatatacaatagtattttaaatatggcacacatctatctatgcatccataaataaaggntatctactgcattcaannnaaaaaaaaa

SEQ ID NO: 1504 - DNA, 498 bp, Ctenocephalides felis
  misc_feature (24)..(24): n = unknown
  misc_feature (28)..(28): n = unknown
attagatttgtccatcttagcatntctnaaagacttctcaacaggctccatggttgatctgaataaatcagcattcaattcttcaaatcgggcacgagtgattgatgtatagaaatcaataccctcaaacaaagaatcaatttcaatgctagcttgggttgaagaagacaaagttctcttcgctctttcacaagatgtcctcaaacgacggagagcacgtttgttggaggtaagatctttcttgtatttgcgtttgaattcttgtacgatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgcctttaccatctttgcagaataagtatcttgtgcagtctttcggatctggctgatat

SEQ ID NO: 1505 - DNA, 354 bp, Ctenocephalides felis
  misc_feature (26)..(26): n = unknown
  misc_feature (90)..(90): n = unknown
  misc_feature (126)..(126): n = unknown
  misc_feature (132)..(132): n = unknown
  misc_feature (152)..(152): n = unknown
  misc_feature (181)..(181): n = unknown
  misc_feature (186)..(186): n = unknown
  misc_feature (224)..(224): n = unknown
  misc_feature (242)..(242): n = unknown
  misc_feature (354)..(354): n = unknown
ggttattaattttcatgtcgatgggnttaggaaaaagattcagtagcaacttctgaattttctttggaattgaaaatactttctcaaagnataattgcatttcacaacacacgacggaaatatggntatggnccatatgaagcaatgctcgntcttctatccacttgcttctgataaatgntcggnataaagaatgcaatcactccacatgctatcagagatgntcctgatattaaaaatgntaaatcgcaattataatctagaattattcctacaacattgcttcaacaacacttcctaatcgacccatcattaaagatatacatactggcattgccctgagttgtgtagggn

SEQ ID NO: 1506 - DNA, 498 bp, Ctenocephalides felis
  misc_feature (466)..(466): n = unknown
atgggatagtgctaaccaaagcaaagattaaccaatctcgcgtcgcccacatcagtaacggcataagaatcattccactggtccacccgatggactgcatcatggcaatgtgtgctctatcttcacttctggatatttccatcgcaattatcaaagggctttgaaaaacagatgtagatgttagtgaaccaagaaaagccgctgttataaaaacaataaaccaactggaagtaaatgctgtaattagtcttccggtgacgattgtgatgagacttaagtaaaatactggtcttcttccaatcctatctcctaattgtccaaaaataaatgtgcctatgacttcgcctgcacgtccaatagcaaatgtattagttacatagagttctctatcacaaacccagtcttgatctgacggagccgttgataaatccatgttctgtcatattcataaccatgctgacaaggnattatttgctttcaatcttatttgctcttcag

SEQ ID NO: 1507 - DNA, 500 bp, Ctenocephalides felis
  misc_feature (36)..(36): n = unknown
  misc_feature (45)..(46): n = unknown
  misc_feature (48)..(51): n = unknown
  misc_feature (110)..(110): n = unknown
  misc_feature (125)..(125): n = unknown
  misc_feature (127)..(127): n = unknown
  misc_feature (155)..(155): n = unknown
  misc_feature (193)..(193): n = unknown
  misc_feature (210)..(210): n = unknown
  misc_feature (231)..(231): n = unknown
  misc_feature (249)..(249): n = unknown
  misc_feature (264)..(264): n = unknown
  misc_feature (267)..(267): n = unknown
  misc_feature (294)..(294): n = unknown
  misc_feature (411)..(411): n = unknown
  misc_feature (461)..(461): n = unknown
  misc_feature (489)..(489): n = unknown
  misc_feature (492)..(492): n = unknown
tttttttttttttttttttttttttttttttttaanaaaaaaagnngnnnnggggttttttacaagcataaataaaatttcttaacttaatagcgcaagaagcatattgnataaaaaaagctttngnataaaggtcttatttttattttcatatngggccctaataagatttatacttaaaacaataaaaaangcgttttattaaaaggngcaagcagttaaataaaatgntgaataaataataggganaaatcattgcataangangcaactcataattattaagtaaattgnctataacaactactacattatcagatctatccggcacttcttaatattcaataatattatggatatcaggcctcttatcactttatagatttttaattaatctatttaatattaaanaaaaaataaatttaaaaccattaaacccgatccgtggctttaaatgaaanaaatcaccataacctttattaagcttgntgnaatatgca

SEQ ID NO: 1508 - DNA, 347 bp, Ctenocephalides felis
  misc_feature (29)..(29): n = unknown
  misc_feature (41)..(41): n = unknown
  misc_feature (47)..(47): n = unknown
  misc_feature (50)..(50): n = unknown
  misc_feature (69)..(69): n = unknown
  misc_feature (78)..(78): n = unknown
  misc_feature (80)..(80): n = unknown
  misc_feature (100)..(100): n = unknown
  misc_feature (103)..(103): n = unknown
  misc_feature (157)..(157): n = unknown
  misc_feature (286)..(286): n = unknown
gccccggccctaattaaattttaaaaaantaagggataggnaaccanttntggttttaaaccgggttgnacctcacancngtgggggggaattaatgggncgnacagaccaaaatttaaaacttctgcattttaaaattatcttaatccaacatcgngggcgcaatctattttggcgatatgttctcttaaaaataattacgctggtatcccttaagtaacttaatcttttaatcataatttatggatcaattattcaattatttatgttttaataaaaaaaaagntttataaatttttctatcccccaataaaatatattaatataaataaaaaaaaaaaaaaaaa

SEQ ID NO: 1509 - DNA, 378 bp, Ctenocephalides felis
  misc_feature (156)..(156): n = unknown
  misc_feature (290)..(290): n = unknown
gaacaataattcgatttcaacaaagagattggattttaattttaatttatattgatcacaaattaataactcgttacattgtaataatactaaacaatctatttacaattaaaaacactcctttcgcaaactttaattctccttcttgatgcgtgnggatgtcattctgtaaataatggagtccctgccagggtccattgtggagatcgagatacagatagcaagtaacgagaagaaaaaggctactccgaaccataaaatgatgttaaaaaccaccgggtaggagtcgntgtattctttagctagggtgaaatcgggttcttttggagcatcatctgcttgccttgcttacgtggtaagacgtcattagagggtagt

SEQ ID NO: 1510 - DNA, 498 bp, Ctenocephalides felis
  misc_feature (132)..(132): n = unknown
  misc_feature (171)..(171): n = unknown
  misc_feature (180)..(180): n = unknown
  misc_feature (300)..(300): n = unknown
  misc_feature (355)..(355): n = unknown
  misc_feature (430)..(430): n = unknown
gatgaaatcaagaaattgttgtaaattaagcaattaacaaccataacaaaaaaagagaaaaatctaaaaacaatttaaattagcaaaaccaagtgtatttgaatttcatttttgcacaagttacctttttgnattaaaatatatgtatatttatgaatatgtatttcttgnattttaggntaaattcgttatagaataatttggaaatcatattcataatgctaaagtattaaattggcttttttccattaaaatcctatttaacattatacatatattttattgcaaatgtgaggcggnatggaatcacgggtggctgctttctgagtagtcgaaccttttaggcaaaaattgngtagatcaaactcagtctacaatcttgagctcatcccattctcagaacattcatgtatttaaggtaacttattgnatttaacagtttttgaggaaatactgaaatatgttaagataatccagttaaaaaaaaaaaaaaaaaaa

SEQ ID NO: 1511 - DNA, 270 bp, Ctenocephalides felis
  misc_feature (80)..(80): n = unknown
  misc_feature (258)..(258): n = unknown
agcagtgatgatagcggagctgtgtctcctgatacaactacaacaatttctcctttaaagaatgctgcagataaaactgngaagactaattaattttaatgccagataaacttgatttttgatatacatatgttggtatgtagttatgaatttaatatactttaattaaacccattccaaaaatcataattcatattttttaaatttgatttaagaaatcttaatgtgtaactttattttgtttttatttagagctgnaaagttttattg

SEQ ID NO: 1512 - DNA, 313 bp, Ctenocephalides felis
  misc_feature (35)..(35): n = unknown
  misc_feature (63)..(63): n = unknown
aattcttggctataagttcgttgcatgttttgcangtgatttgtttattgcatttattcccgnggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 1513 - DNA, 247 bp, Ctenocephalides felis
  misc_feature (40)..(40): n = unknown
  misc_feature (49)..(49): n = unknown
  misc_feature (60)..(60): n = unknown
  misc_feature (126)..(126): n = unknown
  misc_feature (136)..(136): n = unknown
  misc_feature (138)..(138): n = unknown
  misc_feature (185)..(185): n = unknown
  misc_feature (211)..(211): n = unknown
  misc_feature (224)..(224): n = unknown
ggggctggatataaaaaaattggattggaatttttgcagnattaaatcngggctaaaagnatgagtggattaataaaataagattttaaaaatttatatagtatcaacacgaatatcaaaaaaagnttttataggngntctattatacgaagcactcgaaacattaaatctttataaatgaatgntgatcctgtagattacattggagagnagactttggaagnattttatgctcaacaattttagt

SEQ ID NO: 1514 - DNA, 498 bp, Ctenocephalides felis
  misc_feature (29)..(30): n = unknown
  misc_feature (35)..(35): n = unknown
ctgcataccagtcagactgtttaggtgcnngtgtnacttcttccccatccacaccatccttaccatccttaccatctttcccaaccttgccaacatcttccccaacagcaggatttccttttggccgaaaatctcttgatatgcaaacaaaaactggaactaaatgtacaaaaggagaagtttctaaagacgatttaaattctacatgtacctagtgagtgtgttatatgaaattgctattgcatattacatacaagcttaataaaggttatggtgatttatttcatttaaaggcaatgtatcggtttaatggttttaaatttattttttatttaatattaaatagattaattaaaaatctataaagtgataagaggcctgatatccataatattattgaatattaagaagtgacggatagatctgataatgtagtagttggtatagacaatttacttaataattatgagttgcatcattatgcaatgattatcacta

SEQ ID NO: 1515 - DNA, 500 bp, Ctenocephalides felis
  misc_feature (27)..(27): n = unknown
  misc_feature (31)..(32): n = unknown
  misc_feature (38)..(38): n = unknown
  misc_feature (51)..(51): n = unknown
  misc_feature (167)..(167): n = unknown
  misc_feature (200)..(200): n = unknown
  misc_feature (222)..(222): n = unknown
  misc_feature (231)..(231): n = unknown
  misc_feature (236)..(236): n = unknown
  misc_feature (256)..(256): n = unknown
  misc_feature (271)..(271): n = unknown
  misc_feature (316)..(316): n = unknown
  misc_feature (354)..(354): n = unknown
  misc_feature (388)..(388): n = unknown
  misc_feature (399)..(399): n = unknown
  misc_feature (403)..(403): n = unknown
  misc_feature (408)..(408): n = unknown
  misc_feature (411)..(411): n = unknown
  misc_feature (427)..(427): n = unknown
  misc_feature (437)..(437): n = unknown
  misc_feature (439)..(439): n = unknown
  misc_feature (442)..(442): n = unknown
tttttttttttttttttttttttattnaggnntgaganaactatatttggntaggcatctatacatatttacaccagtttccacgtttttataactatattaaatttgaaatttattagcacacttcaatatacaataactttaaataacaacaaaataaaacttgnttaacaatactgagacaattatagtacgtacgngggactaattaaataatttggnacagattgncaggnttttatatactacaatactnaattatttaaaaagnccattttcaactcctaataaaagtatttgagcccactctttctgnagaaagattaaattaaaggtgttcaaaagggagtcggnggtatagagctacattacatttttaaatcttcgnggtgaaaaagngggngctgntgntcaaaatatttttttnagaggttaangntgngagaagcacattaccgatagccctacacagcaaaagggtgaataaatgctggttcaaa

SEQ ID NO: 1516 - DNA, 500 bp, Ctenocephalides felis
  misc_feature (55)..(55): n = unknown
  misc_feature (59)..(59): n = unknown
  misc_feature (69)..(69): n = unknown
  misc_feature (140)..(140): n = unknown
  misc_feature (158)..(158): n = unknown
  misc_feature (285)..(285): n = unknown
  misc_feature (294)..(294): n = unknown
  misc_feature (343)..(343): n = unknown
  misc_feature (375)..(375): n = unknown
  misc_feature (401)..(401): n = unknown
ttttttttttttttttttttttttttttttttggcccaaacgatttatttttatnaaanggatacatgnaatttcataaagcttctatatttatatattttaaataatcagaaattactatagttaatgacattttgttngggctccttacataaaanacaattttatacattttaatttttatacatattttttatatttaattgcacagatcatttgggtatttattatattaattgactactttatgataatttgaatcctaattagtctattcaagattgntttcctggnttaagccttacttagcaatctcacttttgcattcttcgccgggtggcgngggtatgcatcgcaactccgttttatcaaagngcaagccatttggacaatcataatgntttatttgccatttggtggtaaccaagaaacattgataatattttttacaatctcttcgatcggaaaaaacgttttcacttttgcatgcagtctgacga

SEQ ID NO: 1517 - DNA, 450 bp, Ctenocephalides felis
  misc_feature (30)..(30): n = unknown
  misc_feature (34)..(34): n = unknown
  misc_feature (59)..(59): n = unknown
  misc_feature (62)..(62): n = unknown
taatatctgcttacatctgagtattctgtnctcnatgtattttattatttaatatcatngtngggaattacataaattaatatattggatggttgagtgtgtgttaatctcgatgaattatgtaaataccttatataaaacttatttttttggaaacttcttaaattatgacaaaactgttttaaatatgaagagtatccaaattcatataagacatccattgcattgtttagtagaaaaaatatgattttatgtattatttaaatttatatatagaatattaatgactcacagtgtagtgtatatatacatctactataatttattatttacaaattttcccgataaaaatactgttactaaattgctaggcatgtgatcatgtattatgactttgtctacattaggtgtgatcttgataatgaaatatatgagctttgaaatctctaa

SEQ ID NO: 1518 - DNA, 457 bp, Ctenocephalides felis
  misc_feature (358)..(358): n = unknown
  misc_feature (450)..(450): n = unknown
aagaacactatacgtgcgaaaactgagaataaagctcccgctaaaaatactgttctactgctgactttaacacaagcagtcattcctgccaaaaacatccttgatgacaaatctgcagctgctgcagcagacacacaaattgctgtatcagtctttgaccagcctaatgcaaacagatacattgtttgaatagcagaaaatgctatgtcggagtatagtgcaaatgtcactccaataaccatatttacataaatccagtcttttaacaaagttaaatccaaaaagtcaacgataacttgcaattttcccctagatttcttctctaccggtgcagtagtgctatcactgcaatgactgntccagtccaattacctaaactagaaatggaagaccacgtcttctcattctatggtcttcatattgaagcatcttaactggaggtacgccttntatatcc

SEQ ID NO: 1519 - DNA, 277 bp, Ctenocephalides felis
  misc_feature (223)..(223): n = unknown
  misc_feature (235)..(235): n = unknown
ccatccacaattattaaatttagagtagagtttttttttagtaaaaaaaaaaaaaaattaaatgcattatgaaagttgggtatgcactttcttaattaaaatttactgctaaataaagtttatatttatattaaattacaattaggactacataatgcactttaaaaattatggcatagttaagacttcattagaaatacaataagctacaattataaattgnattatattttgnatttttatcataaaagaataaaatcattcagaatgcaaaaaa

SEQ ID NO: 1520 - DNA, 500 bp, Ctenocephalides felis
  misc_feature (30)..(30): n = unknown
  misc_feature (35)..(35): n = unknown
  misc_feature (60)..(60): n = unknown
  misc_feature (136)..(136): n = unknown
  misc_feature (140)..(140): n = unknown
  misc_feature (218)..(218): n = unknown
  misc_feature (418)..(418): n = unknown
  misc_feature (500)..(500): n = unknown
tttttttttttttttttttttttttttttnggccnaaacgatttatttttattaaaaagntacgtgtaatttcataaagcttctatatttatatattttaaataatcagaaattactatagttaatgacattttgnttgngctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgntaaccaagaaacattgataatattttttacaatctcttcgatcggaaaaaacgttttcacttttgcatgcagtctgcacgan

SEQ ID NO: 1521 - DNA, 443 bp, Ctenocephalides felis
  misc_feature (433)..(434): n = unknown
  misc_feature (439)..(439): n = unknown
aggtgcgttacatatctgaattttttttgttaaattatttttaatgtaataaatcatagtaatatttatttccaatttgcaaatatggaaactaccatccctatattatatataattgtatatattcctgaactgttttatttgaatttattttaaacacaaactttaattatattcaaataatgatggacgtgatttcatatatccctaaactttggatcagagtttgagagaagcctagccatagtgtatagaaaattatgtgtaggtgtataattaagattgtcaggagtcaaatatataaagcattgatacaaattatacattccaattttctgtaaaccgtgttctttggttgattatggtttatatcacaatttatgaatcatgtaaattaattgtaaatttgaaatgtatctccgatgtaaatgtnnaaaanaaaa

SEQ ID NO: 1522 - DNA, 495 bp, Ctenocephalides felis
  misc_feature (26)..(26): n = unknown
  misc_feature (32)..(32): n = unknown
  misc_feature (80)..(80): n = unknown
  misc_feature (108)..(108): n = unknown
aaaaaattcagagccccgcaaaggcntagctntatatgactttgaagcagcagaagatacgaattgccttcttagctggngaaataatccatatgctagatgattcanatcctaattggtggaaaggatataatcaacatggagaaggtttatttcctgcaaactttgtaactgctgatttatcagttgaaccagaacaatttagaattgatgctaacaagaaatctgttcaattttctgatgctgttcaagtcaaaactatatctcatgatgatgaaaccagtcctgaaattaatgaagaaagtatagatactttattaaatttattacatgaagcaaatcctgaagatcctaatgatgatacagagcaaatgctcaacttagaagttcaagtaaataaaatgggccctctgattgatgctgaattagaaaatattgacaggaaacatgctcaacttacgcaattgagtggcgatttagtagaagcccttaatt

SEQ ID NO: 1523 - DNA, 498 bp, Ctenocephalides felis
  misc_feature (58)..(58): n = unknown
tgcaaaatgtaggactgctcaatattgttttattagcttttgcatctgttaacttttntttgtaattctcaattctccataccatgtgccccgttccattaaccggttcactcaaagccttatggaaggcccttgcatcttctgcatcttttatctgttgtgacaattgcgccaccaatctctcttgtttaaccaattgccgacttaatttatccaaaatatctgtattatcttgaactgtgcttttcatagatttcaattcgtataaaaaagaagctattcgagctttttgtttgtccaactcgtctgccgttttcgtatgatcttcataaaagttggaagccacttctcgtctcgttttttgggcatctttttgtaattgtattactgattgtcgtatgagatccatgtcttgttctaactcatttactctgcgaagttttttatcctgccgttaatacgacctcgacttgggttctttggggtttcttcatctag

SEQ ID NO: 1524 - DNA, 387 bp, Ctenocephalides felis
  misc_feature (14)..(14): n = unknown
  misc_feature (16)..(16): n = unknown
  misc_feature (60)..(60): n = unknown
atatatcttacatngnatctaaaaacaattaagaattattaattttcatgtcgatgttgnagaaaatgattcaagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1525 - DNA, 460 bp, Ctenocephalides felis
gaggagactttgtttaccgtaatggacaaccattcgaaattccaaaaggaaatttactattgaatgattaaatgtaatagattaatcaaattttagattattaaaattgttctattactacagtagcaacctcagcctgaaaattaaccgaacaaatttctaacccttatcaatgtatagattttgaaaaataacatagaaatactatttttttgatgactgtaataaaaaaatgtataaatggccatacctgaaaagatttctatgtgtattttttattaccttttattgctgaatggataaaagataaatacaatttcataagctcttggattaaattaattttgaataaatccataattataaaatatgttaagtagcaaattgaaatatggaactacaaaatgtatacgaaatataacttatataataaatgaaaaaaaaaaaaaaaaaaaaaaaa

SEQ ID NO: 1526 - DNA, 500 bp, Ctenocephalides felis
ttttcctttttatgtttatttcaaaattataaaacaattgatgatgacgtagaattttacgtcaaaacgcatggaaaaatgtttaaaaatctttacttcaattatttttaaattttttacttgatgttatgctcgcacacacacacacagatatatatatatattgttgagcttcgaacaaagaatccaaaaagtaataaaataatcaaaaaccatttctttatttatttattatcgacgtttcggaactaggtatgttccaacttcaggacatctgtcaagaaacatgattttgataagatttaagcaaacaatatgtttaggaaaattataagatgatggattttttaaattaataacattgttgaaaaaataatatatagaaatatgacaataatcaaaatgaaatgataaaaataaatgagtaacaaaatattgaaaatgttaaaaattgaaaagttttagaaagttttaagaaaaggttctgaaaaaaaacagaa

SEQ ID NO: 1527 - DNA, 431 bp, Ctenocephalides felis
  misc_feature (11)..(11): n = unknown
  misc_feature (31)..(31): n = unknown
  misc_feature (86)..(86): n = unknown
  misc_feature (101)..(101): n = unknown
aatcgggttgnaaattggcatttggcccaanttttaaaattggatggggcccgggtgcataggggtataaaagaattgggatttgngcatttcatgacggngcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 1528 - DNA, 379 bp, Ctenocephalides felis
  misc_feature (22)..(22): n = unknown
  misc_feature (368)..(368): n = unknown
tgaaatgtgaagacgacgtcancgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtatnaaaaaaaaaaa

SEQ ID NO: 1529 - DNA, 325 bp, Ctenocephalides felis
  misc_feature (31)..(31): n = unknown
  misc_feature (60)..(61): n = unknown
gaaaaaatttgtagtattaaataaaaaaaangccatattaatttttcttgttacataagnngtaaatatattacatcactcgtaaggcttgtcatcgttaaagtaaacatataatttattattcaccaatcagttcatttatcataacaaagacatatataataagattttagtttaattataaaaaatgctaaaaaatatttttaacaaaaacgcaatagaattatttatgaattattacttaacatttcaaaaggtgcatatttggtgataaataaacaaatgcattagagataagcaaatatttatgaaaagtatgaacagt

SEQ ID NO: 1530 - DNA, 410 bp, Ctenocephalides felis
tgaaatgtgaagacgacgtcaacgaatggtttgacccaaaatctttctcgtgcagagctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtaaaaaaaaaaaaaaaaaaaaaaaaaaaaa

SEQ ID NO: 1531 - DNA, 437 bp, Ctenocephalides felis
  misc_feature (47)..(47): n = unknown
  misc_feature (71)..(71): n = unknown
  misc_feature (75)..(75): n = unknown
cgcgggacaagaaccctatacgtgcgaaaaactgagaattaaagctnccgcttaaaatactgttctactgntggnctttaacacaagcagtcattcctgccaaaaacatccttgatgacaaatctgcagctgctgcagcagacacacaaattgctgtatcagtctttgaccagcctaatgcaaacagatacattgtttgaatagcagaaaatgctatgtcggagtatagtgcaaatgtcactccaataaccatatttacataaatccagtcttttaacaaagttaaatccaaaaagtcaacgataacttgcaattttcccctagatttcttctctaccggtgcagtagtgctatcactgacaatgactgctccagtccaattacctaaactagaaatggaagatccacgtcttctcattctatgttcttcatattga

SEQ ID NO: 1532 - DNA, 260 bp, Ctenocephalides felis
  misc_feature (50)..(50): n = unknown
  misc_feature (205)..(205): n = unknown
tttttttttttttttttttttttttgcttcttacttttaattttatttgnttggtttttatattaactctatatctttatctatctatctattagttcaaccaataaaattaagcgtaaaatgaataattttgattagaacaaatatattcatggatttaaaaaaatctaaattgtaaaattcttaaatgccttatcatatttgngagcctgtgttcaaccataatatttttttatataacacataaagtaaaacaaagt

SEQ ID NO: 1533 - DNA, 337 bp, Ctenocephalides felis
  misc_feature (40)..(41): n = unknown
  misc_feature (43)..(43): n = unknown
  misc_feature (66)..(66): n = unknown
  misc_feature (70)..(70): n = unknown
caagaacactatacgtgcgaaaactgagaataaattttcnntntaaaaatactggtctactgctgncttnaacacaagcagtcattcctgccaaaaacatccttgatgacaaatctgcagctgctgcagcagacacacaaattgctgtatcagtctttgaccagcctaatgcaaacagatacattgtttgaatagcagaaaatgctatgtcggagtatagtgcaaatgtcactccaataaccatatttacataaatccagtcttttaacaaagttaaatccaaaaagtcaacgataacttgcaattttcccctagatttcttctctaccggtgcagt

SEQ ID NO: 1534 - DNA, 500 bp, Ctenocephalides felis
  misc_feature (60)..(60): n = unknown
  misc_feature (393)..(393): n = unknown
  misc_feature (396)..(396): n = unknown
ttttggacggcccaaacgatttatttttattaaaaagatacatgtaatttcataaagctnctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgntgntaaccaagaaacattgataatattttttacaatctcttcgatcggaaaaaacgttttcacttttgcatgcagtctgcacgagaaagatttgggtcaaaccattc

SEQ ID NO: 1535 - DNA, 439 bp, Ctenocephalides felis
gagaaatatttcgagggcgccaacgcctttttagcgagaggacacatgtctcccgatgcagattttacattcgccatttggcaatatgccacctacttctatgtcaatgtttgcccacaatggcaggccgtgaatgctggaaactggttacgtgtagaaaatctagcaagaaaattgggatcttccagagctgaagatttgaccgtctattcaggtgtccatgatatcctaactctgcctgatgtcaataacaacgaagtaaaaatgtctattgccaaagacggaaacatttggatacccaaatggaattggaaaatagtacaatcgccaaaaactggagaaggcattgcttttgttaccctcaataatccttatgcagagaaagtcctcataaagatctactctgcaaggacatctgcaaagaactggatttgaagat

SEQ ID NO: 1536 - DNA, 500 bp, Ctenocephalides felis
  misc_feature (4)..(4): n = unknown
  misc_feature (118)..(118): n = unknown
  misc_feature (135)..(135): n = unknown
  misc_feature (237)..(237): n = unknown
  misc_feature (249)..(249): n = unknown
  misc_feature (385)..(385): n = unknown
  misc_feature (452)..(452): n = unknown
  misc_feature (489)..(489): n = unknown
tttntttccgggccatacaactctaagctttgcaacatttgtattttattcaaataaatataaataaaaatcataattcgacaattttactcgtatttatcttaaacatatttacagnatttcctcaaaaactgntaaatacaataagttaacttaaatacatggatgttctgagaatgtggatgagctcaagattgtagaactgagtttgatctacacaatttttgcctaaaaggntcgactactcanaaagcagccacccgtgattccataccgcctcacatttgacaataaaatatatgtataatgttaaataggattttaatggaaaaaagccaatttaatactttagcattatgaatatgtatttccaaattattctatnacgaatttaacctaaaatacaagaaatacatattcataaatatacatatattttaatacaaaaaggnaacttggcaaaaatgaaattcaaatcacttgggttgntaatttaaatg

SEQ ID NO: 1537 - DNA, 498 bp, Ctenocephalides felis
  misc_feature (28)..(28): n = unknown
  misc_feature (52)..(53): n = unknown
  misc_feature (368)..(368): n = unknown
  misc_feature (410)..(411): n = unknown
  misc_feature (477)..(477): n = unknown
tttctttagtggtgcactgtagatatcnactttgatcagcgcacacttgatnntgggctacaggattccttaaccggatctgctcctatttccggacaatactgcatttcgggtgaactgcacgaattcacgcaactaaattttacttttttacatttttgcaatataatacatatatattataaaaaagtaaaaaatcgttattaaaataattaattacacgggatatattagatagttaattttataataaattgtattatataatagggaatataatacatatatattataaaaagtaaaaaaatcgttattaaaataattaattacacgggatatattagatagttaattttataataaattgnattatataatagggaatataatcatatatattataaaaaagnnaaaaatcgttattaaaataattaattacacgggatatattagataggtaattttataataaattgnattatataatagggaatataa

SEQ ID NO: 1538 - DNA, 500 bp, Ctenocephalides felis
  misc_feature (7)..(7): n = unknown
  misc_feature (18)..(20): n = unknown
  misc_feature (28)..(28): n = unknown
  misc_feature (137)..(137): n = unknown
  misc_feature (157)..(157): n = unknown
  misc_feature (382)..(382): n = unknown
  misc_feature (394)..(394): n = unknown
  misc_feature (459)..(459): n = unknown
  misc_feature (475)..(475): n = unknown
  misc_feature (491)..(491): n = unknown
ttttttnttttttttttnnnacaaacancttataaaattggatttatcttttatccgttcaacaataaaatgttaacaaaaaaatacacatagaaatcttttcagacatggccatttaaacattttttcattaaggntatcaaaaatatatcaggcntggccatttatacattttttttattagagtcatcaaaaaaaatagtataatttctatgttattattcaaaatctatacattaataaggatgttagaagtttgttcggttaattttcaggcagaggttgctattgtagtaatagaacaattttaatcatctaaaatttgattaatctattcatttaatcattcaatagtaaatttccttttggaatttcgaatggntgccattacggnaaacaaagtctcctcgtcaacagttgcatgaactttgcccttcaacgcattcctaagtatggggnttctttattcttgggntggattatgctttagngccttaaat

SEQ ID NO: 1539 - DNA, 481 bp, Ctenocephalides felis
  misc_feature (58)..(58): n = unknown
  misc_feature (405)..(405): n = unknown
  misc_feature (420)..(420): n = unknown
  misc_feature (440)..(441): n = unknown
  misc_feature (474)..(474): n = unknown
tgaaatgtgaagacgacgtcaacgaatggtttgacccaaaatctttctcgtgcagaantgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggngcacaaacaaaatgncattactatagtatttctgnntatttaaaatatataaatatagaagcttatganaaaaaaa

SEQ ID NO: 1540 - DNA, 381 bp, Ctenocephalides felis
  misc_feature (11)..(11): n = unknown
  misc_feature (25)..(25): n = unknown
  misc_feature (70)..(70): n = unknown
  misc_feature (103)..(103): n = unknown
  misc_feature (220)..(220): n = unknown
  misc_feature (349)..(349): n = unknown
  misc_feature (375)..(375): n = unknown
gggaatttggntcaattaacagccntttaatagcacttacatatctcactactataataattagaaatgngttaaaataaaattcaagctctaattactttgncgatacaagctctattttcattccatgccataataagattatctcttaattttgaatgccaaatgtcatatcattttctcagctaacatttataaattatgaatatgaaataatggntaaattggattatagttgacttcctacatgtagaaattagacacagtagaaatgaaacataaatatatctttggagaatcttaaattctaagcaattataaattaggaaacgttaaataattgcaacantttacatatcctatatattattatgnaaaacg

SEQ ID NO: 1541 - DNA, 269 bp, Ctenocephalides felis
  misc_feature (44)..(44): n = unknown
  misc_feature (110)..(110): n = unknown
  misc_feature (152)..(152): n = unknown
  misc_feature (231)..(232): n = unknown
  misc_feature (236)..(236): n = unknown
  misc_feature (251)..(251): n = unknown
catataaattgttgaagaaaagttgtttatttgtatttatttgnaaatattggggaaggtaaatatataaagattggttttatgggttatatgtctaacatttattttgnaacatacagttaagaacacaatagaaaaatcatttaattagntggatatttttagtataagtattcctgtgtagatagcaagttgtgactacagaataaatatctgattttatcacaaggnnaaanaaaaaaaaaaaaaanaaaaaaaaaaaaaaaaaa

SEQ ID NO: 1542 - DNA, 464 bp, Ctenocephalides felis
  misc_feature (28)..(28): n = unknown
  misc_feature (58)..(58): n = unknown
  misc_feature (62)..(63): n = unknown
  misc_feature (89)..(89): n = unknown
  misc_feature (315)..(315): n = unknown
cgaggagactttgtttccgtaatggcanccattcgaaattccaaaaggaaatttactnttgnntgattaaatgtaatagattaatcaanttttagattattaaaattgttctattactacagtagcaacctcagcctgaaaattaaccgaacaaatttctaacccttatcaatgtatagattttgaaaaataacatagaaatactatttttttgatgactgtaataaaaaaatgtataaatggccatacctgaaaagatttctatgtgtattttttattaccttttattgctgaatggataaaagataaatacantttcataagctcttggattaaattaattttgaataaatccataattataaaatatgttaagtagcaaattgaaatatggaactacaaaatgtatacgaaatataacttatatataaatgaaaaaaaaaaaaaaaaaaaaaaaaaaaaaa

SEQ ID NO: 1543 - DNA, 416 bp, Ctenocephalides felis
  misc_feature (19)..(19): n = unknown
  misc_feature (59)..(59): n = unknown
  misc_feature (202)..(202): n = unknown
  misc_feature (300)..(300): n = unknown
  misc_feature (381)..(381): n = unknown
  misc_feature (395)..(395): n = unknown
  misc_feature (400)..(400): n = unknown
acatatcttacatcgaatntaataacaataaagagttattaattttcatgtcgatgttntagaaaatgattcagtagcaacttctgaattttctttgtaattgataatactttctcaaagtataattgcatttcacaacacacgacggaaatatggttatggtccatatgaagcaatgctcgttcttctatccacttgcttntgataaatgttcggtataaagaatgcaatcactccacatgctatcagagatgttcctgatattaaaaatgttaaatcgcaattataatctagaaattnttcctacaacattggttccaacaacacttcctaatcgacccatcattaaagattacatactgcattggcctgagttgggangggacctggccggnacccnctaaccgaattttgga

SEQ ID NO: 1544 - DNA, 415 bp, Ctenocephalides felis
  misc_feature (22)..(22): n = unknown
  misc_feature (37)..(38): n = unknown
  misc_feature (96)..(96): n = unknown
  misc_feature (112)..(112): n = unknown
  misc_feature (165)..(165): n = unknown
  misc_feature (167)..(167): n = unknown
  misc_feature (211)..(211): n = unknown
  misc_feature (239)..(239): n = unknown
  misc_feature (292)..(292): n = unknown
  misc_feature (295)..(295): n = unknown
  misc_feature (297)..(297): n = unknown
  misc_feature (328)..(328): n = unknown
  misc_feature (369)..(369): n = unknown
  misc_feature (372)..(372): n = unknown
  misc_feature (380)..(380): n = unknown
tttttttttttttttttttttnggatttcataaagcnnctatatttatatattttaaataatcagaaattactatagttaatgacattttgtttgngctccttacataaaanacaattttatacattttaatttttatacatattttttatatttaattgcacanancatttgggtatttattatattaattgactactttatgataattngaatcctaattagtctattcaagattgntttcctgggttaagccttacttagcaatctcacttttgcattcttcgccgggnggngngggtatgcatcgcaactccgtttatcaaagngcaagccatttggcaatcataatggtttatttggcatttgntgntaaccaanaaacaatgataatatttttacaactcttcgatcgg

SEQ ID NO: 1545 - DNA, 418 bp, Ctenocephalides felis
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtcagcgtcaacttcaaagtagaacaatcgtgacaaaatgttccactgcttattaat

SEQ ID NO: 1546 - DNA, 320 bp, Ctenocephalides felis
  misc_feature (41)..(41): n = unknown
  misc_feature (45)..(45): n = unknown
  misc_feature (55)..(55): n = unknown
  misc_feature (110)..(110): n = unknown
  misc_feature (130)..(130): n = unknown
  misc_feature (145)..(145): n = unknown
  misc_feature (164)..(164): n = unknown
  misc_feature (178)..(178): n = unknown
  misc_feature (181)..(181): n = unknown
  misc_feature (199)..(199): n = unknown
  misc_feature (231)..(231): n = unknown
  misc_feature (262)..(262): n = unknown
  misc_feature (265)..(265): n = unknown
  misc_feature (286)..(286): n = unknown
  misc_feature (290)..(290): n = unknown
  misc_feature (299)..(299): n = unknown
taacggcccaaacgatttatttttattaaaaagagacatgnaagntcataaagcntctatatttatatattttaaataatcagaaattactatagttaatgacattttgnttgggctccttacataaaanacaattttatacatnttaatttttatacatattnttttatatttaaantgnacaggaacatttgggggntttattatattaattgactactttatgataantttgaatcctaattagtctattcaagaatgnttnctgggttaagccttacttaanaatnttactttgnattctttgcgggggggggggg

SEQ ID NO: 1547 - DNA, 126 bp, Ctenocephalides felis
cttaactacttttttttaaaatctacaagagtgcatggtaatattgcttgtcgcaattaattttgaatattctaaaagtttaaattcgttgtttactagaaataaataattctgaagtagtaaagt

SEQ ID NO: 1548 - DNA, 310 bp, Ctenocephalides felis
  misc_feature (20)..(20): n = unknown
  misc_feature (63)..(63): n = unknown
  misc_feature (92)..(92): n = unknown
  misc_feature (117)..(117): n = unknown
  misc_feature (175)..(175): n = unknown
  misc_feature (238)..(238): n = unknown
  misc_feature (252)..(252): n = unknown
cgggacgcaatttcaagcantttttacttcaatactcagcatattatttttgagccaaatggncacatctgccagcatacaggattgggttnatgatgaattgagtcaacaaccttnattgaacctggttttaccacaaagaccagaacatatattaacagattgtatgcacgtnacatcagaagacggtgacttctttttcaaaagcaatggtgtcgaagattcttcagcagaaagntccagtttgtggtntctatttgatcacagaagccaacatgagggttgagttgacaattaggcattttgatgt

SEQ ID NO: 1549 - DNA, 491 bp, Ctenocephalides felis
  misc_feature (47)..(47): n = unknown
  misc_feature (63)..(63): n = unknown
  misc_feature (67)..(67): n = unknown
  misc_feature (180)..(180): n = unknown
  misc_feature (251)..(251): n = unknown
  misc_feature (292)..(292): n = unknown
  misc_feature (342)..(342): n = unknown
  misc_feature (358)..(358): n = unknown
  misc_feature (387)..(387): n = unknown
  misc_feature (404)..(404): n = unknown
  misc_feature (434)..(434): n = unknown
  misc_feature (465)..(465): n = unknown
  misc_feature (469)..(469): n = unknown
atctcgatagttcgcgactcataaataattatttaaacaatgaatgntaaaaaaaattaaagnttgngaatataatatatgtattggattaacttagttaattctccctcgcacttttatactatagtaaccagaaacaaaaatcagagtgtgtaaaatgtaaattcatatatttttggnaaaaatacaatcaagatataacagtgccacaatattattaaaatacgtatttgtgacgaaacctaaagtgnggtcagaatataaaaaacaataatatttatccttcaaatgnatgctttgaaaaaaagcattcgaagattttggttaaatattttggtaagnccacatttatggttgntcggtcaattaaaatatgtttcttttgcnaggaaagaatatggtgnagatattggccaaaaatagtatatttatgngaatttaagcatattggtttttttgggaaancggnctattggccccaaattaaataa

SEQ ID NO: 1550 - DNA, 314 bp, Ctenocephalides felis
aattcttggctataagttcgttgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattccgtttcttagttctggaagtttttgaacgttacaacccgatttctcgcaacacattttttctcggttagtcgagtcacaactttctttaaccgt

SEQ ID NO: 1551 - DNA, 210 bp, Ctenocephalides felis
  misc_feature (15)..(15): n = unknown
  misc_feature (129)..(129): n = unknown
  misc_feature (207)..(207): n = unknown
aaggtttcaaatgtncgtcaccatcgagattttatccaaatataaatgattgtcaaagctattattattgtgacgaaaatagtataggaacccaatattattgccccgcaaattttgcatatgatccgntacgtcataattgcggacctatggctctgggcacaaaatgctatacagttacatgtcctgcacaggctaaggtgcttncgt

SEQ ID NO: 1552 - DNA, 255 bp, Ctenocephalides felis
  misc_feature (42)..(42): n = unknown
  misc_feature (57)..(58): n = unknown
  misc_feature (68)..(68): n = unknown
  misc_feature (82)..(82): n = unknown
  misc_feature (158)..(158): n = unknown
  misc_feature (186)..(186): n = unknown
  misc_feature (214)..(214): n = unknown
cggcgacaaaacacttgaagataaattctttgaacatgaggntcatctcaatgtgtnngctttcttgnaacaattccatttnggagtattttactcttatttgaaactcaaggaacaagagtgccgtaacattgtttggataagtgagtgcgttgctnaaaagcacaggaccaagattgacaactncattccaatattttaattaatttggtgntaattttgataacgttgattttatccagatgtttgttgtgt

SEQ ID NO: 1553 - DNA, 500 bp, Ctenocephalides felis
  misc_feature (23)..(23): n = unknown
  misc_feature (54)..(54): n = unknown
  misc_feature (300)..(300): n = unknown
  misc_feature (311)..(311): n = unknown
  misc_feature (448)..(448): n = unknown
  misc_feature (464)..(464): n = unknown
  misc_feature (489)..(489): n = unknown
gggtaacatatttattagaatgntttatatcacattggtttttattagttttgnggcgttatctgtcgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatnctgtagcccanatcaagtgtgcgctgatcaaagtggatatctacagtgcaccactaaagaaagtcagtctgcaagtacaagggttcaaatgtccgtcaccatcgagattttattcaaatataaatgattgcaaagctattattattgngacgaaaatagtatangaacccaatattttggcccgcaaantttgatatgat

SEQ ID NO: 1554 - DNA, 421 bp, Ctenocephalides felis
  misc_feature (259)..(259): n = unknown
  misc_feature (345)..(345): n = unknown
  misc_feature (348)..(348): n = unknown
  misc_feature (413)..(413): n = unknown
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataaagtatcttgtgcagtctttcggatctggctgatatcctacaaccgcgcatgtagtttctgncgcttacagttttccccaggttttgatgagcacatatcatctacacaaaatggagcatcggaatttgagtctctgcaattgattgntgnaattggggtttcttgtcagcgcacaacttcaaagtagaacaatcgtgacaaaatgttccaactgnttattagt

SEQ ID NO: 1555 - DNA, 390 bp, Ctenocephalides felis
  misc_feature (363)..(363): n = unknown
aaatctccgctctgcaatcctccccaatccaaccttctgatcaaataggaagccaactgcaagctgtccaagttctacccacaaacctcggtttgcacacacacagacaccaaaacaactatgcatcaccccaacaaaccaactttggatcctttcaccatcaccaacaaatagcacctacaaacattgggggctactattccccccacggaattctaccaatctattacgataatggacacggtttgttgaattttaatcctctgaggcagcaaaactactacgcccagtattatccttattaccagaacacgagacagtattatccttacaattttggatattattatcatcacagtttgncaaattcgcactactacaggcaggagt

SEQ ID NO: 1556 - DNA, 417 bp, Ctenocephalides felis
taacctctaatgacgtcttaacacgtaagacaaggcaagcagatgatgctccaaaagaacccgatttcaacctagctaaagaatacaacgactcctacccggtggtttttaacatcattttatggttcggagtagcctttttcttctcgttacttgctatctgtatctcgatctccacaatggaccctggcagggactccattatttacagaatgacatccacacgcatcaagaaggagaattaaagtttgcgaaaggagtgtttttaattgtaaatagattgtttagtattattacaatgtaacgagttattaatttgtgatcaatataaattaaaattaaaatacaatatctttgttgaaatcgaattattggtctattatatttttggtttacattcctagtattaccgaattg

SEQ ID NO: 1557 - DNA, 276 bp, Ctenocephalides felis
cagcaaaacgtttccataactaggatatcctacttgaaagtgatggctattgttggtacttattgcatttggtccaaaaatctcaggcttataatattggcccacagaagaatatcctggcctgtactgagaaaatgcgtaaggtggtggatggtaatcacagttcgcccattggacaatcgagatggccaccaaaaatattacagctttcattttagtcacttggtgaaatatcacgaattgaaatatttcaaccttcgcaaaaggagcttgtga

SEQ ID NO: 1558 - DNA, 364 bp, Ctenocephalides felis
  misc_feature (18)..(18): n = unknown
  misc_feature (24)..(24): n = unknown
  misc_feature (31)..(31): n = unknown
  misc_feature (34)..(34): n = unknown
  misc_feature (49)..(49): n = unknown
  misc_feature (100)..(100): n = unknown
  misc_feature (220)..(220): n = unknown
  misc_feature (247)..(247): n = unknown
  misc_feature (259)..(259): n = unknown
  misc_feature (305)..(305): n = unknown
  misc_feature (310)..(310): n = unknown
  misc_feature (326)..(326): n = unknown
  misc_feature (350)..(350): n = unknown
tttttttttttttttttntttttnataaagnttntatatttatatattngaaataatcagaaattactatagttaatgacattttgtttgggctccttanataaaatacaattttatacattttaatttttatacatattttttatatttaattgcacagatcatttgggtatttattatattaattgactactttatgataatttgaatcctaattagnctattaaagattgttttcctggtttangccttacttagnaatctcacttttgcatttttcgccggggggcgtgggtatgcatcgnaactncgttttattaaagtgnaagccatttggacaatcataatgntttatttgcatttg

SEQ ID NO: 1559 - DNA, 483 bp, Ctenocephalides felis
  misc_feature (142)..(142): n = unknown
  misc_feature (204)..(204): n = unknown
  misc_feature (224)..(224): n = unknown
  misc_feature (283)..(283): n = unknown
  misc_feature (349)..(349): n = unknown
  misc_feature (378)..(378): n = unknown
  misc_feature (387)..(387): n = unknown
  misc_feature (399)..(399): n = unknown
  misc_feature (403)..(403): n = unknown
  misc_feature (421)..(421): n = unknown
  misc_feature (477)..(477): n = unknown
ctttaaatatctaaatcagtgtttcccaacctgtggagcgcgtatgactgttttaggaaaggtgctagtatttgcaaaatagcagtgtcaatgaaccagaaaaaattaaaaaaaaaaaatactttaaattaaacaaaggtcnaaatcagtgtttttcaatctgtggtgcgcgcaaggcagttttcagaaggctgaaactgtttncaaaatactatttttgaatncaaaccaaaaaaagaaatatataaaaatataagattgaagatacaagaaaaaatattgntagaaagaatgccaatctttacaaaacaaaaacattttataaaaattagcattccttctatcaatntttttttttaaacaatatatatcagttgnaaatttatnaaatcatattgntggngaaattaaaaaaaaattnaaacgccaaaatttaaaaatgagggcccgcggtgttggaagattgggaaccactgnttaact

SEQ ID NO: 1560 - DNA, 498 bp, Ctenocephalides felis
  misc_feature (348)..(348): n = unknown
  misc_feature (403)..(403): n = unknown
  misc_feature (432)..(432): n = unknown
  misc_feature (438)..(438): n = unknown
  misc_feature (485)..(485): n = unknown
  misc_feature (491)..(491): n = unknown
gaggagactttgtttaccgtaatggacaaccatttgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaatcatactatttttttgatgactctaataaaaaaatgtataaatagccatgcctgatatatttttgatgaccttaataaaaaaatgtttaaatggccatgtctgaaaagatttctatgtgtatttttttgttaacattttattgntgaatggataaaagataaatcaattttataaagctgtttggataaattaattttngaataaatctataatcatagaatatgttnagtgcnaattaaaatatggccacaaccacaaaatgaatacgaatatacttatntgattnttgaaaa

SEQ ID NO: 1561 - DNA, 210 bp, Ctenocephalides felis
caaatgatattaactttataattttttttttataaaaatccaaaattttctcacgtgcgccaaaaattgtgctacaaaagtaaaacatctggtgcttaacatatttttgttcaagcactaaaaatagtgtttaatttgaccttaaccactttggtttatatttagcaaaaatttattaaaagcgatataaataatattgataattaaagt

SEQ ID NO: 1562 - DNA, 118 bp, Ctenocephalides felis
  misc_feature (61)..(61): n = unknown
  misc_feature (64)..(64): n = unknown
  misc_feature (67)..(67): n = unknown
  misc_feature (74)..(74): n = unknown
  misc_feature (82)..(82): n = unknown
  misc_feature (107)..(107): n = unknown
  misc_feature (109)..(109): n = unknown
cctgttttttcttctggtcattatgctgaattgcaagaaccttgttaatgctgcgtgcatnaanaangcgcctncaatgaanatattccgtagccgaagagttcttntnagtgatggt

SEQ ID NO: 1563 - DNA, 136 bp, Ctenocephalides felis
ttttttttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 1564 - DNA, 378 bp, Ctenocephalides felis
  misc_feature (88)..(88): n = unknown
  misc_feature (206)..(206): n = unknown
  misc_feature (295)..(295): n = unknown
  misc_feature (301)..(301): n = unknown
  misc_feature (364)..(364): n = unknown
gtttaggaaaggtgctaggatttgcaaaatagcaggggcaatgaaccagaaaaaattaaaaaaaaaatactttaaattaaacaaaggnctaaatgagtggttttcaatctgtggtgcgcgcaaggcagttttcagaaggctgaaactgtttcaaaatactatttttgaatacaaaccaaaaaaagaaatatataaaaatataagantgaagatacaagaaaaaatattgatagaaagaatgccaatttttacaaaataaaaacattttataaaaattagcattttttctattaanattttnttttaaacaatatatatcagtgaaaatttataaaatcatattggtggagaaattaaaaaaaanaattaaaacgcaaa

SEQ ID NO: 1565 - DNA, 171 bp, Ctenocephalides felis
  misc_feature (43)..(43): n = unknown
  misc_feature (45)..(45): n = unknown
  misc_feature (63)..(63): n = unknown
  misc_feature (89)..(89): n = unknown
  misc_feature (112)..(112): n = unknown
  misc_feature (157)..(157): n = unknown
  misc_feature (171)..(171): n = unknown
tgcttggagaaagtgcagttggaaaaagttctttggtgttaananttgtcaaggggcagtttnatgaatatcaagagtctactataggngctgcgtttttaactcaaactgngtgtctggatgacacaacgggtaaatttgaaatttgggatacggntggacaagaaaggn

SEQ ID NO: 1566 - DNA, 414 bp, Ctenocephalides felis
  misc_feature (1)..(1): n = unknown
  misc_feature (66)..(66): n = unknown
  misc_feature (262)..(262): n = unknown
  misc_feature (390)..(390): n = unknown
ncacacaattagcaataggaaaatctagccacaaatatttttaacaatttatttaatacttatgtnctagaaatacaaagtgtaaagttcaaggtttgtatagcttaataaagtaaacattttaaaatgtgatgaatttatctgcaaatagtcaaaatcaaaattactatataatgattattgaaataatgcttttatagattgcatttcaatctgtattaaattgtatgtaaatcacagcacaagatctaacacacaattnatctaacagaaagaactaaataattttaatgttattaaaaattacatataaaataacttttacaataaagtaaccttacatgagatgtgttgatttcagatacttttcatacaacagtgctttctgtntaaacaatataatataaataacgg

SEQ ID NO: 1567 - DNA, 498 bp, Ctenocephalides felis
  misc_feature (24)..(24): n = unknown
  misc_feature (144)..(144): n = unknown
  misc_feature (296)..(296): n = unknown
  misc_feature (377)..(377): n = unknown
  misc_feature (403)..(403): n = unknown
  misc_feature (419)..(419): n = unknown
  misc_feature (422)..(422): n = unknown
  misc_feature (430)..(430): n = unknown
tttttttttttttttttttttttnacaaaggaacggcccaaacgatttatttttattaaaaagatacatgtaatttcataaagcttctatatttatatattttaaataatcagaaattactatagttaatgacattttgtttgngctccttacataaaatacaattttatacattttaatttttatacatattttttatatttaattgcacagatcatttgggtatttattatattaattgactactttatgataatttgaatcctaattagtctattcaagattgttttcctggnttaagccttacttagcaatctcacttttgcattcttcgccgggtggcgtgggtatgcatcgcaactccgttttatcaaagngcaagccatttggacaatcataatgntttatttgccatttgntgntaaccaanaaacattgataatattttttacaatctcttcgatcgggaaaaacgttttcacttttgcatgcagtttt

SEQ ID NO: 1568 - DNA, 500 bp, Ctenocephalides felis
  misc_feature (63)..(63): n = unknown
  misc_feature (73)..(73): n = unknown
  misc_feature (119)..(119): n = unknown
  misc_feature (147)..(147): n = unknown
  misc_feature (185)..(185): n = unknown
  misc_feature (204)..(204): n = unknown
  misc_feature (209)..(209): n = unknown
  misc_feature (221)..(221): n = unknown
  misc_feature (223)..(223): n = unknown
  misc_feature (237)..(237): n = unknown
  misc_feature (250)..(250): n = unknown
  misc_feature (255)..(255): n = unknown
  misc_feature (257)..(257): n = unknown
  misc_feature (319)..(319): n = unknown
  misc_feature (359)..(359): n = unknown
  misc_feature (373)..(373): n = unknown
  misc_feature (391)..(391): n = unknown
  misc_feature (431)..(432): n = unknown
  misc_feature (455)..(455): n = unknown
  misc_feature (482)..(482): n = unknown
ttttttttttttttttttttttttggaataaataaagcatttattgtttttttacaagcatangaaaaatggnttaacttaatagcgcaagaagcatattgtataaaaaaagcttttgnataaaggtcttatttttattttcatatngggccctaataagatttatacttaaaacaataaaaaangcggtttattaaaaggggnaggcnggtaaataaaangngaataaataatagngataaatcattgnataangnggcaactcataattattaagtaaattgggtataacaactactcattatcagatctatccggncttcttaatattcaataatattatggggatcaggcccctnatcactttataganttttaattaatctatttnatattaaataaaaaataaatttaaaaccattaaacccganncatgggctttaaagaaaaaaaancaccatacctttattaagcttgggtgnaatatgcaatagccattt

SEQ ID NO: 1569 - DNA, 384 bp, Ctenocephalides felis
  misc_feature (15)..(15): n = unknown
  misc_feature (164)..(164): n = unknown
  misc_feature (218)..(218): n = unknown
  misc_feature (363)..(363): n = unknown
aatatatcttacatngaatctaataacaataaagagttattaattttcatgtcgatgttttagaaaatgattcagtagcaacttctgaattttctttgtaattgataatactttctcaaagtataattgcatttcacaacacacgacggaaatatggttatggnccatatgaagcaatgctcgttcttctatccacttgcttctgataaatgttcggnataaagaatgcaatcactccacatgctatcagagatgttcctgatattaaaaatgttaaatcgcaattataatctagaattattcctacaacattgctttcaacaacacttctaatcgacccatcattaaagatatacatactgncattgcctgagttgtgtaggg

SEQ ID NO: 1570 - DNA, 482 bp, Ctenocephalides felis
  misc_feature (28)..(28): n = unknown
  misc_feature (50)..(50): n = unknown
  misc_feature (64)..(64): n = unknown
  misc_feature (66)..(66): n = unknown
  misc_feature (79)..(79): n = unknown
  misc_feature (97)..(97): n = unknown
  misc_feature (118)..(118): n = unknown
  misc_feature (173)..(173): n = unknown
  misc_feature (189)..(189): n = unknown
  misc_feature (192)..(193): n = unknown
  misc_feature (207)..(207): n = unknown
  misc_feature (211)..(211): n = unknown
  misc_feature (226)..(226): n = unknown
  misc_feature (293)..(293): n = unknown
  misc_feature (356)..(356): n = unknown
  misc_feature (374)..(374): n = unknown
  misc_feature (382)..(382): n = unknown
  misc_feature (440)..(440): n = unknown
  misc_feature (452)..(452): n = unknown
ttttttttttttttttttttttaaaatntcataaagcttgtatatttatntattttaaataatnanaaattactatagntaatgacattttgtttgngctccttacataaaatacaantttatacattttaatttttatacatattttttatatttaattgcacagatcattngggtatttattatatnaanngactactttatganaatntgaatcctaattagnctattcaagatcgttttcctggtttaagccttacttagcaatctcacttttgcattcttcgccgggnggcgtgggtatgcatcgcaactccgttttatcaaagtgcaagccatttggacaatcataatgntttatttgcatttggtgntaaccaanaaacattgataatattttttacaatctcttcgaacggaaaaaacgttttcacttttgnatgcagttctgnacgagaaagaatttgggtcaaaacattcgg

SEQ ID NO: 1571 - DNA, 498 bp, Ctenocephalides felis
  misc_feature (43)..(43): n = unknown
  misc_feature (184)..(184): n = unknown
  misc_feature (194)..(194): n = unknown
  misc_feature (457)..(457): n = unknown
  misc_feature (473)..(473): n = unknown
aaagcctatcttgggggcatttatgagtttgcaggggcttggngggatccacagctgatacaatgtgtgaaatattagctttttgaagctgacagacgtgtcataatcataacaatcaactcgtttggaactgaatttgagcaaggatgatcgtgctaaattgtacccccgttgtggtaaactnaacccagacnggttagctgctctggctcgtgctgatgattatgaacaagttaaagctgtagctgaatattatgctgagtattctgctttattcgaaggctcttggcgatggtccggcgacaaaacacttgaagataaattcttttgaacatgaggtcatctcaatgtgttgctttcttgcacaattcatttcggagtattttactcttatttgaaactcaaggacaagagtgccgcaacattgttggataagtggtgcgtggtcaaagcacangaccaaattgcactcnttccatttttaataattggtgtaat

SEQ ID NO: 1572 - DNA, 324 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgtactattcgtagcatcaatgcttagggcggacgacttcattgatactacgaatagt

SEQ ID NO: 1573 - DNA, 380 bp, Ctenocephalides felis
  misc_feature (31)..(31): n = unknown
  misc_feature (61)..(61): n = unknown
  misc_feature (77)..(77): n = unknown
  misc_feature (98)..(98): n = unknown
  misc_feature (121)..(121): n = unknown
  misc_feature (127)..(127): n = unknown
  misc_feature (167)..(167): n = unknown
  misc_feature (177)..(177): n = unknown
  misc_feature (186)..(186): n = unknown
  misc_feature (200)..(200): n = unknown
  misc_feature (217)..(217): n = unknown
  misc_feature (220)..(220): n = unknown
  misc_feature (233)..(233): n = unknown
  misc_feature (235)..(236): n = unknown
  misc_feature (241)..(241): n = unknown
  misc_feature (253)..(253): n = unknown
  misc_feature (259)..(259): n = unknown
  misc_feature (264)..(264): n = unknown
  misc_feature (281)..(281): n = unknown
  misc_feature (300)..(300): n = unknown
atatttttaacaatttatgtaatacttatgntctagaaatacaaagtgtaaagttcaaggngttgtatagcttaatnaagtaaacattttaaaatgtnatgaatttatcgtgcaaatagtnaaaatnaaaattactatataatgattattgaaataatgcttttatngattgcattncaatctggnttaaattgtatgtnaatcacagcacaagatntancacacaattcatntnncaganagaacaaaatanttttantgttnttaaaaattacatatanaataacttttcaataaagnaaccttacatgagatgtgttgattttagatacttttcatacaacagtgctttctgttaaacaatataatataaataacgg

SEQ ID NO: 1574 - DNA, 428 bp, Ctenocephalides felis
  misc_feature (106)..(106): n = unknown
  misc_feature (156)..(156): n = unknown
  misc_feature (259)..(259): n = unknown
  misc_feature (324)..(324): n = unknown
  misc_feature (369)..(369): n = unknown
  misc_feature (386)..(386): n = unknown
  misc_feature (410)..(410): n = unknown
tttaaattagcaaaaccaagtgtatttgaatttcatttttgcacaagttacctttttgtattaaaatatatgtatatttatgaatatgtatttcttgcttttaggntaaattcgctatagaataatttggaaatacatattcataatgctaaagtnttaaattggcttttttccattaaaatcctatttaacattatacatatattttattgcaaatgtgaggcggtatggaatcacgggtggctgctttctgagtagncgaaccttttaggcaaaaattgtgtagatcaaactcagtctacaatcttgagctcatccacattntcagaacatccatgtatttaagttaacttattgtatttaacagtntttgaggaaatactgtnaatatgtttaagataatacaagtnaaaaaaaaaaaaaaaaaa

SEQ ID NO: 1575 - DNA, 313 bp, Ctenocephalides felis; identical to SEQ ID NO: 1334

SEQ ID NO: 1576 - DNA, 404 bp, Ctenocephalides felis
  misc_feature (18)..(18): n = unknown
  misc_feature (28)..(29): n = unknown
  misc_feature (42)..(42): n = unknown
  misc_feature (48)..(48): n = unknown
  misc_feature (57)..(57): n = unknown
  misc_feature (67)..(67): n = unknown
  misc_feature (73)..(73): n = unknown
  misc_feature (79)..(79): n = unknown
  misc_feature (96)..(96): n = unknown
  misc_feature (110)..(110): n = unknown
  misc_feature (125)..(125): n = unknown
  misc_feature (150)..(150): n = unknown
  misc_feature (176)..(176): n = unknown
  misc_feature (180)..(180): n = unknown
  misc_feature (198)..(199): n = unknown
  misc_feature (208)..(208): n = unknown
  misc_feature (277)..(277): n = unknown
  misc_feature (331)..(331): n = unknown
  misc_feature (355)..(355): n = unknown
  misc_feature (386)..(386): n = unknown
cccattatttcaattaanttggaagggnnatttaaatttggncatgcnttatcaaantatatttatnattatnggggtnaaataaaataattttgnggtaaagcctctgnaataaaaagaactgnctcatatgtataaagatttaattgnataaatgcaatacaaaataattacangttnaaatttaagaacatattnnatgacaggnttgttataaaagcataaatgactggttagttttttttttttttaatgaaagtttaagacatctattatnggaagatatatggggggaacagaatcattacatatacatcaacatcaatgggcntacttttttttttaatttctcttnagatagaatccgatgaatataaacataagtntgaattataaatgggttg

SEQ ID NO: 1577 - DNA, 498 bp, Ctenocephalides felis
  misc_feature (31)..(31): n = unknown
  misc_feature (60)..(60): n = unknown
  misc_feature (84)..(84): n = unknown
  misc_feature (96)..(96): n = unknown
  misc_feature (149)..(149): n = unknown
  misc_feature (178)..(178): n = unknown
  misc_feature (185)..(185): n = unknown
  misc_feature (187)..(187): n = unknown
  misc_feature (195)..(195): n = unknown
  misc_feature (212)..(212): n = unknown
  misc_feature (247)..(247): n = unknown
  misc_feature (266)..(266): n = unknown
  misc_feature (274)..(274): n = unknown
  misc_feature (282)..(282): n = unknown
  misc_feature (312)..(312): n = unknown
  misc_feature (390)..(390): n = unknown
  misc_feature (431)..(431): n = unknown
  misc_feature (456)..(456): n = unknown
  misc_feature (459)..(459): n = unknown
  misc_feature (464)..(464): n = unknown
  misc_feature (477)..(477): n = unknown
  misc_feature (480)..(480): n = unknown
  misc_feature (483)..(483): n = unknown
aacagttgcatgaactttgcccttcaacgtnattcctaaagtatgggggggtctttattngttgtgttggattatgtctttagngaccttaaattnctcctcaggatcccaaataactaaatcagcatccaagccttctttgatttgtncttttatgccatccagtccagttaatttngcaagtncncgcagatnataaacgagaatacatnatgagctttaaaggccctttttagaaagcaccggnccataataaaagattattnaaaattgnataccagnaatttcaccccatgcttttaggaaaatcangatgacaaccattgcacagggccttttcagtgcagcaggcgatggtgaatgatcactaactaccatatcaatatcttntgttttcaaagctggcataatttttcttggatacttctttntaattgggggagcgcatttgtattnagnatgtncattttggacatnttnagnagcaaagggtaagtt

SEQ ID NO: 1578 - DNA, 484 bp, Ctenocephalides felis
  misc_feature (27)..(27): n = unknown
  misc_feature (35)..(35): n = unknown
  misc_feature (47)..(47): n = unknown
  misc_feature (64)..(64): n = unknown
  misc_feature (69)..(69): n = unknown
  misc_feature (72)..(72): n = unknown
  misc_feature (74)..(74): n = unknown
  misc_feature (80)..(80): n = unknown
  misc_feature (107)..(107): n = unknown
  misc_feature (114)..(114): n = unknown
  misc_feature (137)..(137): n = unknown
  misc_feature (155)..(155): n = unknown
  misc_feature (189)..(189): n = unknown
  misc_feature (194)..(194): n = unknown
  misc_feature (211)..(212): n = unknown
  misc_feature (217)..(217): n = unknown
  misc_feature (226)..(226): n = unknown
  misc_feature (274)..(274): n = unknown
  misc_feature (295)..(295): n = unknown
  misc_feature (298)..(298): n = unknown
  misc_feature (313)..(313): n = unknown
  misc_feature (336)..(336): n = unknown
  misc_feature (344)..(344): n = unknown
  misc_feature (346)..(346): n = unknown
  misc_feature (369)..(369): n = unknown
  misc_feature (376)..(376): n = unknown
  misc_feature (409)..(409): n = unknown
  misc_feature (454)..(454): n = unknown
  misc_feature (459)..(459): n = unknown
  misc_feature (466)..(466): n = unknown
ttttttttttttttaaaaaaaaaagcntttattgnttttttacaagnataaataaaatttcttnacttnatngngcaagnagcatattgtataaaaaaagcttttgnataaagntcttatttttattttcatattgngccctaataagatttatncttaaaacaataaaaaatgcgttttattaaaagntgggngccggtaaataaaatgnngaatnaataatagngataaatcattgcataatgatgcaactcataattattaagtaaattgnttataacaactctacattatnagntctatccggcccttnttaatattcaataatattatggntatcaggncncttatcactttatagattttaantaatctntttaatattaaataaaaaataaatttaaaaccntttaacccggtcattgcctttaatggaataaatcacctacctttnttaanttggtgnaattgcatagcattttat

SEQ ID NO: 1579 - DNA, 385 bp, Ctenocephalides felis
  misc_feature (385)..(385): n = unknown
atatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccatggcctgagttgtgtagggn

SEQ ID NO: 1580 - DNA, 171 bp, Ctenocephalides felis
  misc_feature (18)..(18): n = unknown
  misc_feature (65)..(65): n = unknown
  misc_feature (93)..(93): n = unknown
  misc_feature (101)..(101): n = unknown
  misc_feature (107)..(108): n = unknown
  misc_feature (119)..(119): n = unknown
  misc_feature (137)..(137): n = unknown
  misc_feature (144)..(144): n = unknown
tttcataaagcttctatntttatatattttaaataatcagaaattactatagttaatgacatttngtttgggctccttacataaaaaacaacnttatacantttaanntttatacatantttttatatttaattgcncagaacntttggggatttattatattaattgact

SEQ ID NO: 1581 - DNA, 389 bp, Ctenocephalides felis
atctttatcagtgagccagttagacataacgtgaccacatatacctacagcatcccattcaatgttagatagacctgatacatcggagtaagtagcctgcgaaagcaaatgctgtaaggcgtgtccaaatttgttgaataaaattgatacctcttttagagacagaagagaaggtatattgccctcaggagggatttagacttaaaattaatgatgctaatggtgttgtatccacaattttacttttattgcgcatactcaacatccatcctgaactcttttggaatatcttctcttcttctctagtataaggatctaaataaaatcagccagtggcaattcagctgcagaatcatgtatatcaaaataccttacatctttatgccaag

SEQ ID NO: 1582 - DNA, 537 bp, Ctenocephalides felis
  misc_feature (207)..(207): n = unknown
  misc_feature (304)..(304): n = unknown
  misc_feature (325)..(325): n = unknown
  misc_feature (393)..(393): n = unknown
  misc_feature (396)..(396): n = unknown
  misc_feature (442)..(442): n = unknown
  misc_feature (486)..(486): n = unknown
  misc_feature (508)..(509): n = unknown
  misc_feature (526)..(526): n = unknown
gctctctaccgtatcatgtgctgcatcttttattttatcaccagctttctctgttgatcccttcaacttgccaaagaatcctttagttttgtctgctgcatcttcagtgacttctttcgttttatctttgacttccttagcatgctccttcgtgggttcaatcgtgtcatctgcagcgtctttcaccttatcgacggccttttctgntgatcccttcaatttgccaaagaatctttagttttgcctgctgcatcttcagcgacttctttcgtttatctttgatatcttgagcatgctcttttgngctctctaccgtatcatctgntgcgtctttacttatcaacaagctttttctgtgatcccttaacttgccaaaaatccttagtttgctgntgnatcttcagcgactcttcgtttatcttgactcttagcaggtcttcgngattcatcgggcataagagcgcttttacctataacggccttttntgtgatccttaattgcaaaganncttaagtttgctggtgnattttaggatt

SEQ ID NO: 1583 - DNA, 263 bp, Ctenocephalides felis
  misc_feature (13)..(14): n = unknown
  misc_feature (37)..(37): n = unknown
  misc_feature (44)..(44): n = unknown
  misc_feature (76)..(76): n = unknown
  misc_feature (109)..(109): n = unknown
  misc_feature (112)..(112): n = unknown
  misc_feature (166)..(166): n = unknown
  misc_feature (253)..(253): n = unknown
ctgcttttatgannatgtaagctgtaaaaaaacaatntgttgtncatatatatttgatacacaaaaatgtcctgtntgcttatttttttaatccaaagaaataaaagancanataaacgtaaaaaataactacattatgaaccccaataaaatataatactcctgngtaacgcggtatgtcgtgttcccaatgtaattttatgtaaatatgtataatttgaaagctcgtatattgcttgttctattttcttgnatataaatgt

SEQ ID NO: 1584 - DNA, 118 bp, Ctenocephalides felis
  misc_feature (13)..(13): n = unknown
  misc_feature (35)..(35): n = unknown
  misc_feature (38)..(38): n = unknown
catcaccgagaanaactcttcggctacggaatatnttnattggaggcgcgttgttggtgcacgcagcattaacaaggttcttgcaattcagcataatgaccagaagaaaaatacaggt

SEQ ID NO: 1585 - DNA, 424 bp, Ctenocephalides felis
  misc_feature (391)..(391): n = unknown
cgtttcattgttgaattgcttggtgaatgaaaatttcactcatgggttcttcttcgtgttctccatgagctgcttttggcggtgcctttggtgcctctggcataccgttttcttggctggagacaacgtctgaggtcatttccattccttggtttaaatcaccattagatttagcagaatgaggagcttcatctttatttttcttggttgccatcaaatataatggtttgcccaagagcatgagcggaatacagcagagcccaattaacacaaatattttttgaatttgctgttgtccttcaaacataaattcatcgcaatgttctgctggagatccttgcttgaataacatcatgttaatgaacagaatcaaaactgatggtgcgcacanggttcaaatctgatgtctgtttatttgcagagt

SEQ ID NO: 1586 - DNA, 469 bp, Ctenocephalides felis
  misc_feature (29)..(29): n = unknown
  misc_feature (70)..(70): n = unknown
  misc_feature (166)..(166): n = unknown
  misc_feature (293)..(293): n = unknown
  misc_feature (298)..(298): n = unknown
  misc_feature (330)..(330): n = unknown
  misc_feature (356)..(356): n = unknown
  misc_feature (370)..(370): n = unknown
  misc_feature (415)..(415): n = unknown
ttcaagcccttttttttttttttcaattncataaagcttctatatttatatattttaaataatcagaaantactatagttaatgacattttgtttgggctccttacataaaatacaattttatacattttaatttttatacatattttttatatttaattgcacanatcatttgggtatttattatattaattgactactttatgataatttgaatcctaattagtctattcaagattgttttcctggtttaagccttacttagcaatctcacttttgcattcttcgccgggnggcgngggtatgcatcgcaactccgttttatcaaagngcaagccatttggacaatcataatgntttatttgccattngttggtaaccaagaaacattgataatattttttacaatctcttcnatcggaaaaaacgtttcactttttgcatgcagttctgcacgagaaagatttggg

SEQ ID NO: 1587 - DNA, 457 bp, Ctenocephalides felis
  misc_feature (272)..(272): n = unknown
  misc_feature (369)..(369): n = unknown
  misc_feature (404)..(404): n = unknown
  misc_feature (421)..(421): n = unknown
  misc_feature (425)..(425): n = unknown
agtatctcacaccgcctcttatttgcgtctgtgggccctgtcacttgctcacgcacaactttcagacgtattgtggaaaatggtgttgtccatgggattgaaccaaacaacatatactggctcgattatgctctatgtgatattctgcgtgtgggcactattcacaattgccatcctagtcatgatggaaggcctttctgcgttcttgcacacactgcgtcttcactgggtggagttcatgagtaagttctactctggtttgggttatttgnccaacccttctgcttcaaaactattttggacgcggaggataaggaagcagaataatcaatttatctattatttaaataaattaaaaaaacaaattanttataaagaagttataaaaaagtaaattattggtnaaaattgattttcaaangtcngtaggggttttgaattaacactaatttgtagt

SEQ ID NO: 1588 - DNA, 590 bp, Ctenocephalides felis
  misc_feature (18)..(18): n = unknown
  misc_feature (21)..(21): n = unknown
  misc_feature (23)..(23): n = unknown
  misc_feature (27)..(27): n = unknown
  misc_feature (54)..(54): n = unknown
  misc_feature (59)..(59): n = unknown
  misc_feature (89)..(89): n = unknown
  misc_feature (122)..(122): n = unknown
  misc_feature (325)..(325): n = unknown
  misc_feature (331)..(331): n = unknown
  misc_feature (349)..(349): n = unknown
  misc_feature (360)..(361): n = unknown
  misc_feature (493)..(493): n = unknown
agtctaggcccttggtcnctntnagcncttggcggcccccggctgtcaatcaantattnattgactatataaataatatacagatgttngttaaaattgcatacaacatgaacatttcattntcttctatttttgacaaagtttattttaaacaggtgttgaaataatttcagtgtacagctttactttactggcaacactcatatcaacataacgatctccaattgatacgaccattccacccaagattgagggattaactttaagggttagtaataagttttctttgggttttaagaatcctcttaaagtgctttcaagttgnttttgntgattctcatctaaaggnttagctgttgnnacttcacatggacctctccacgatgagcagacatcataactttataagcggtgatacaccctccagttattaaacgtccattctcagcaagtactccacaagttggatgtactgggagccatttgcagctgnttgtggcttcttcatgcattgattaaaggagcgcttgaaagtggttggcatgaaaccggaatttacatcggcctttaagtatttgggttttggcaaa

SEQ ID NO: 1589 - DNA, 207 bp, Ctenocephalides felis
  misc_feature (207)..(207): n = unknown
agagaggattcaggaaagctcttcttcgtcgcctgattttggagccgagttggttcaaccaattcaccaggatcgtgaatctaatgaacatgaagaacaattcaacaagcaccatcatcacaagcaacacaaagctgattatatgaatcacatgagagtcaccgacacttcggcaatcatggctggttcttttgctgtgatagcggn

SEQ ID NO: 1590 - DNA, 507 bp, Ctenocephalides felis
  misc_feature (428)..(428): n = unknown
  misc_feature (430)..(430): n = unknown
  misc_feature (448)..(448): n = unknown
  misc_feature (480)..(480): n = unknown
atacatatccaaaattcaacaagactatgccatactggatcataaaaaattcctggggtccccgctggggcgaacaaggatattaccgagtataccgtggtgatggaacttgcggagtggaccaaatggctacttcagcggttttggataaaccagttgttaactagacaaaaatacaccaagtgccaaatatgatcctgtccaaacctttccatgtttataagtagtgtccaaacaaattatcttcggcgactgaaatattggacaacttgcatgcatttttgactattttaaattgacaggtcagcattatttatgtctggcagaataacagaggcaaaacaaacaaatgtcgatcaaatattacaattcgatgtgctcttaattggattaaatatagatttatactaattcaaaaagcaatctgntnttaaaatgagaatataangagccaggccgtcagttttcttttacatggtnaaatatcgatcacataagaatcctttt

SEQ ID NO: 1591 - DNA, 499 bp, Ctenocephalides felis
  misc_feature (323)..(323): n = unknown
  misc_feature (387)..(387): n = unknown
taagcctttcgccgccaggtcaatcaattatttattgactatataaataatatacagatgttagttaaaattgcatacaacatgaacatttcattttcttctatttttgacaaagtttattttaaacaggtgttgaaataatttcagtgtacagctttactttactggcaacactcatatcaacataacgatctccaattgatacgaccattccacccaagattgagggattaactttaagggttagtaataagttttctttgggttttaagaatcctcttaaagtgctttcaagttgtttttgttgattctcatctaaaggnttagctgttgtaacttcacatggaacctctccacgatgagcagacatcataactttataagtgntgataacaccttccagtttatttaaacgtccattctcagcaagtactccagcaaggtgggatgtactggagccattgcagcttgctgtggctttcttcatgcattgattaaa

SEQ ID NO: 1592 - DNA, 368 bp, Ctenocephalides felis
cagtgatcaacaaaatgatattgtcaatcatataactgtaggttatgaaatccaagaaagtggacagaggttcgacagcatggtttctcatgtgttggaattcaataaccaatttttcacgtaatttgtcatcaatggtagacacagataagggggaaggctcatttgataaaaaggtgccataatctgtaactgccaggtgcagcttcaaatcttcaagagtttcacattgcacaagatttaaataatcggattgtttaagaattccgcacttgaaaccacggcacaggccttccagatagccaccatcaatattaaacatgaaacccatttttattcaatttatctggcagtaatcgctcgtatta

SEQ ID NO: 1593 - DNA, 356 bp, Ctenocephalides felis
  misc_feature (354)..(354): n = unknown
ccgtcaagtccaatccaaaagtggaagctttttcaggaaagttactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaagggtatatangc

SEQ ID NO: 1594 - DNA, 470 bp, Ctenocephalides felis
  misc_feature (60)..(60): n = unknown
  misc_feature (75)..(75): n = unknown
  misc_feature (414)..(414): n = unknown
  misc_feature (430)..(430): n = unknown
  misc_feature (443)..(443): n = unknown
  misc_feature (456)..(456): n = unknown
cctacacaactcagggcaatggcagtatgtatatctttaatgatgggtcgattaggaagngttgttggaagcaangttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgcatgaaaattaataactctttattggtattagattcgatgtaagatatatgtacatactcataggtaaaaaatgttaatgncgccatggtcaaaatnttaagagaattanttaatccttaaanaaaaaaaaaaaaaa

SEQ ID NO: 1595 - DNA, 503 bp, Ctenocephalides felis
  misc_feature (178)..(178): n = unknown
  misc_feature (349)..(349): n = unknown
  misc_feature (440)..(440): n = unknown
  misc_feature (451)..(451): n = unknown
  misc_feature (453)..(453): n = unknown
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgnatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttggtaacattttattgntgaatggataaaagataaatcaattttataagctggttggataaattaattttgaataaatcataatcatagaatatggtaagtagcaaantaaaatatggncncaaaccacaaaatgtttcgaaatatacttatatgatatttggagagaaaa

SEQ ID NO: 1596 - DNA, 498 bp, Ctenocephalides felis
  misc_feature (34)..(34): n = unknown
  misc_feature (36)..(36): n = unknown
  misc_feature (51)..(51): n = unknown
  misc_feature (94)..(94): n = unknown
  misc_feature (115)..(115): n = unknown
  misc_feature (170)..(170): n = unknown
  misc_feature (172)..(172): n = unknown
  misc_feature (234)..(234): n = unknown
  misc_feature (237)..(237): n = unknown
  misc_feature (290)..(290): n = unknown
  misc_feature (295)..(295): n = unknown
  misc_feature (368)..(368): n = unknown
  misc_feature (379)..(379): n = unknown
  misc_feature (443)..(443): n = unknown
  misc_feature (453)..(453): n = unknown
  misc_feature (463)..(463): n = unknown
  misc_feature (466)..(466): n = unknown
  misc_feature (472)..(472): n = unknown
  misc_feature (481)..(481): n = unknown
tttttttttttttttttttttatttcataaagcntntatatttatatattngtaaataatcagaaattactatagttaatggcattttgtttgngctccttacataaaatacaantttatacattttaatttttatacatattttttatatttaattgcacagatcattngngtatttattatattaattgactactttatgataatttgaatcctaattagtctattcaagantgntttcctggtttaagccttacttagcaatctcacttttgcattcttcgccgggnggcgngggtatgcatcgcaactccgctttatcaaagtgcaagccatttggacaatcataaaggttatttgccatttgntggtaaccaanaaacattgataatattttttacaatctcttcgatcgggaaaaacgtttcacttttgcatgcagntctggacganaaaaaatttnggncaaaancatcgtggngcggcttcacaattaaa

SEQ ID NO: 1597 - DNA, 563 bp, Ctenocephalides felis
  misc_feature (350)..(350): n = unknown
  misc_feature (386)..(386): n = unknown
  misc_feature (472)..(472): n = unknown
  misc_feature (478)..(478): n = unknown
cgcccccggaccaaccctttattgaatcaggagagcaatgggacttcccaaatgcctgggcacctcttcagcatatggtgatcctgggattggacagcacagataatcaggaagctaaggatttgtcatttgatctttgccagaaatgggtccgatcaaatcataaagcttacttggaaacgaatcatatgtatgaaaagtataatgccacacatgctggggcaccaggaaatggcggagaatatgaggtccagcttggttttggctggacgaatggtgtcatattagaccttcttaataaatacggagatcgactgagctctacatcaaattcgctcacatcagatggntcgtcgtaaatcttttggaataatcttgaagactgngaaattagtgaaaaaattactactagaagaatatacgagtattaagggtatatatagcgtagatgactttgctactatttatttgngggacnatttaatttggattttacactatgatcatttttatttaaatttatatcttcatgccccattagaaacctattatttagcccctaa

SEQ ID NO: 1598 - DNA, 240 bp, Ctenocephalides felis
  misc_feature (66)..(66): n = unknown
  misc_feature (83)..(83): n = unknown
  misc_feature (89)..(89): n = unknown
  misc_feature (143)..(143): n = unknown
  misc_feature (150)..(151): n = unknown
  misc_feature (165)..(165): n = unknown
  misc_feature (180)..(180): n = unknown
  misc_feature (237)..(237): n = unknown
tttctttagtggtgcactgggagatatccactttgatcagcgcacacttgatctgggctacaggantccttaaccggatctgntcctanttccggacaatactgcatttcgggtgaactgcacgaattcacgcaactaaattntactttnntacatttttgcaanataagcatatgtatnataaaaaagggaaaaatcgttattaaaataaataattacacgggatatattagatangga

SEQ ID NO: 1599 - DNA, 522 bp, Ctenocephalides felis
  misc_feature (3)..(3): n = unknown
  misc_feature (33)..(33): n = unknown
  misc_feature (43)..(43): n = unknown
  misc_feature (62)..(62): n = unknown
  misc_feature (199)..(199): n = unknown
  misc_feature (201)..(201): n = unknown
  misc_feature (236)..(236): n = unknown
  misc_feature (322)..(322): n = unknown
  misc_feature (333)..(333): n = unknown
  misc_feature (353)..(353): n = unknown
  misc_feature (379)..(379): n = unknown
  misc_feature (395)..(396): n = unknown
  misc_feature (398)..(398): n = unknown
  misc_feature (463)..(463): n = unknown
  misc_feature (487)..(487): n = unknown
  misc_feature (517)..(517): n = unknown
ttnttttttaacggtccaaacgatttatttttnttaaaaagangggtgtaatttcataaagnggctatatttatatattttaaataatcagaaattactataggtaatgacattttgtttgtgctccttacataaaatacaatttatacattttaatttttatacatattttttatatttaattgcacagatcatttgngnatttattatattaattgactactttatgataattngaatcctaattagtctattcaagattgttttcctggtttaagccttacttagcaatctcacttttgcattcttcgccgggtggcgngggtatgcatngcaactccgtttatcaaagngcaagccatttggacaatcataatgntttatttgccatttgnngntaaccaagaaacattgataatattttttacaatctcttcgatcggaaaaaacgtttcacttttgnatgcagtctgacgagaaagatttngggcaaaacattcgtgcgtcgcttacattnaagta

SEQ ID NO: 1600 - DNA, 320 bp, Ctenocephalides felis
  misc_feature (43)..(43): n = unknown
  misc_feature (86)..(86): n = unknown
  misc_feature (91)..(91): n = unknown
  misc_feature (224)..(224): n = unknown
  misc_feature (235)..(235): n = unknown
  misc_feature (291)..(291): n = unknown
  misc_feature (296)..(296): n = unknown
ttttttttttttttttttttttaatttcataaagcttctatanttatatattttaaataatcagaaattactatagttaatgacantttgnttgggctccttacataaaaaacaattttatacattttaatttttatacatattttttatatttaattgcacagatcatttggggatttattatattaattgactaccttatgataatttgaatcctaattagnctattcaagantggtttcctgggttaagccttacttagcaatctcacttttgcattcttcgccgggnggcgngggtatgcatcgcaactcggttta

SEQ ID NO: 1601 - DNA, 507 bp, Ctenocephalides felis
  misc_feature (18)..(18): n = unknown
  misc_feature (391)..(391): n = unknown
  misc_feature (397)..(397): n = unknown
  misc_feature (473)..(473): n = unknown
  misc_feature (479)..(479): n = unknown
tttttttttttttttttnggacaattttacttgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatcatattcataaatatacatatattttaatacaaaaaggnacttgngcaaaaatgaaattcaaatcccttgggtttgctaatttaaatggtttagaattttctctttttttggtatgggggntattgnttaattacaacaatttcttgatttatcg

SEQ ID NO: 1602 - DNA, 459 bp, Ctenocephalides felis
  misc_feature (27)..(27): n = unknown
  misc_feature (33)..(34): n = unknown
  misc_feature (37)..(37): n = unknown
  misc_feature (43)..(43): n = unknown
  misc_feature (59)..(59): n = unknown
  misc_feature (182)..(182): n = unknown
  misc_feature (245)..(245): n = unknown
  misc_feature (254)..(254): n = unknown
  misc_feature (303)..(303): n = unknown
  misc_feature (361)..(361): n = unknown
  misc_feature (380)..(380): n = unknown
  misc_feature (420)..(420): n = unknown
ttttttttttttttttttttttttttnggaacnncanaaagcntctatatttatatatnttaaataatcagaaattactatagttaatgacattttgtttgggctccttacataaaatacaattttatacattttaatttttatacatattttttatatttaattgcacagatcatttgggnatttattatattaattgactactttatgataatttgaatcctaattagtctattcaagattgntttcctggnttaagccttacttagcaatctcacttttgcattcttcgccgggtggcgngggtatgcatcgcaactccgttttatcaaagtgcaagccatttggacaatcataatgntttatttgccatttggtgntaaccaagaaacattgataatattttttacaatctcttcnatcggaaaaaacgtttcacttttgcatgcagtctgccga

SEQ ID NO: 1603 - DNA, 598 bp, Ctenocephalides felis
  misc_feature (425)..(425): n = unknown
  misc_feature (494)..(494): n = unknown
  misc_feature (515)..(515): n = unknown
  misc_feature (541)..(541): n = unknown
  misc_feature (562)..(562): n = unknown
  misc_feature (565)..(565): n = unknown
  misc_feature (567)..(567): n = unknown
  misc_feature (577)..(577): n = unknown
  misc_feature (593)..(593): n = unknown
tatcttttgctaccaatgctcaaaggcgataatggacccacagcctggcgtccaaaatgcttcctcgtccgcaacgacatagtcgttttgcaagatttatccatgtataattttcgccattcgtacccaaaattctctttggatcttgatcatgttaaagttgctttaacggcattggctcgtatgcatgcaagttgcattatctacgagaagaaaaaaaattgttgcatggggagagtttacaaagatcttatgttcgagactatggccaataataatcaatggtggaggactggagaggatactgctttagcaattgctgaggaatctgagaaattcggtaaatataccgaataccattccatggtcaggagaagttaattgatttcctgagattggcatggctatggtaaaaccatcgcgcntttataaaaatgtggtatgccccgcgataccccaatcacaaattgatggtcaaatataattcaactggnctcctgacaatgcatcttggncgatttccaagatccctacatccacnactttggattcaatcatcttnttntnagacaacatntaaaagctttgagacncccct

SEQ ID NO: 1604 - DNA, 505 bp, Ctenocephalides felis
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatcaattttataagctgtttggataaattaattttgaataaatccataatcatagaatatgttaagtagcaaattaaaatatggaccacaaaccacaaaatgtatacgaaatataacttatatgatttttaaaaaaaa

SEQ ID NO: 1605 - DNA, 408 bp, Ctenocephalides felis
  misc_feature (165)..(165): n = unknown
  misc_feature (370)..(370): n = unknown
cgttatttatattatattgtttatacagaaagcactgttgtatgaaaagtatctgaaatcaacacatctcatgtaaggttactttattgtaaaagttattttatatgtaatttttaataacattaaaattattttgttctttctgttagatgaattgtgtgttanatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattgntaaaaatatttgtggctagattttcctattgctaattg

SEQ ID NO: 1606 - DNA, 300 bp, Ctenocephalides felis
  misc_feature (72)..(72): n = unknown
ccctggcatatcgttaactccagaatatattatctgatttcagatctctatgtgcaattccataagctgatnaatgggcaatcgcttccaaaagttgagcaaacaaaattatggacgtcctcattgatattttattactactaagataatcatgaagactgcaatcgtatctcttcattaacaaaaacaatgacatatttctaccataaccatcactgttaattctttgtggtaaagctgatggaaacaaactggctgctagtggtaaaccagttggaattctatcagcaaacacgctgt

SEQ ID NO: 1607 - DNA, 541 bp, Ctenocephalides felis
  misc_feature (324)..(324): n = unknown
  misc_feature (403)..(403): n = unknown
gatttgaaaataagcattttcatctaagtcatgacaaaaattcaaatacatcttattgggtattaatatttggtcctttgactaggaaattcactaaacaattaatggataaataattcgggaaagtgtgtttcatacgtaggctccattgctaaagtctcgtttgatggtaaagcattaacaccacgtaagtttttggaaaattttaatgaactgaatatgtcgttcagtttgttacgtaagagttcatgctgtggctttgttcgggtcaacaattcatcaaatggttcatttctaaacgctttggcaagtcgtttatattgntcctcttgcagtaattgttcagactcagtttgttcatttactgctcgtttcatgacatcaaaagaatattcttcggtgntaattttcctggataatcctggtgaacttgctgcgctatccacatcgttggttaaagagctcaaatccgtacactttctaaagaagtgccagcctcgacccactatgttgtgaaccatgttcatagttatcgggcatg

SEQ ID NO: 1608 - DNA, 431 bp, Ctenocephalides felis
  misc_feature (33)..(33): n = unknown
  misc_feature (109)..(109): n = unknown
  misc_feature (123)..(123): n = unknown
  misc_feature (303)..(303): n = unknown
  misc_feature (306)..(306): n = unknown
  misc_feature (365)..(365): n = unknown
  misc_feature (384)..(384): n = unknown
  misc_feature (389)..(389): n = unknown
tgtaactttatattttatattgctatgtatatncacaatatgatcaaattttaacagttaaattgaatttattagattatataaaactgaaaattatcatggaatgtantttaaaatcatacngaaaaaaacaaatataataataaaatttgataatatttcaacaacttgtagctagtacggcagaatactgtttcacaacaacatactttcattttaacaatagaatcattattttataagtatctacaatttctttaaacattaaaacatgtcttcatgttttccttacattaaggatgnggntagtaccagacatcccaaaaactgatttaatattctttacatggagaagacatcatatnaagggaaataaaatatggnattgntggaaactttagtaagatttttaatgacgagaatccctgggt

SEQ ID NO: 1609 - DNA, 510 bp, Ctenocephalides felis
  misc_feature (500)..(501): n = unknown
  misc_feature (503)..(503): n = unknown
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgattttttnnanaaaaaaa

SEQ ID NO: 1610 - DNA, 445 bp, Ctenocephalides felis
  misc_feature (28)..(28): n = unknown
  misc_feature (38)..(38): n = unknown
  misc_feature (46)..(46): n = unknown
  misc_feature (57)..(57): n = unknown
  misc_feature (101)..(101): n = unknown
  misc_feature (161)..(161): n = unknown
  misc_feature (403)..(403): n = unknown
aacaaaaaaataaaaaataacccatttnctgggattcnttgaatantaaatatgttntgggtgtatttttttttcgtaaaaaaaataaccaatatctacanttgtctttgacacaatatattaataacagacactaacatagtctttgaaataacatagtnttaatatttgtattaaggcactcaatactataggaatacttggaacgcgcattgctaaattcctcgcttatccaaaatacgtataaatacttattatcaattataggggcatattgctaaatgacttaaaatcaataaaaagcgaatctcgcgtataaaaaaatgccatcatcatatctcactgtgtgtaaaaatattaaaaatttgatcaccgatgattttgctgatcacaacttatgctngactcacaatatgtgaattaaacatgagctctcttatatttg

SEQ ID NO: 1611 - DNA, 386 bp, Ctenocephalides felis; identical to SEQ ID NO: 498

SEQ ID NO: 1612 - DNA, 504 bp, Ctenocephalides felis
  misc_feature (30)..(30): n = unknown
  misc_feature (33)..(33): n = unknown
  misc_feature (36)..(36): n = unknown
  misc_feature (88)..(88): n = unknown
  misc_feature (241)..(241): n = unknown
  misc_feature (299)..(299): n = unknown
  misc_feature (357)..(357): n = unknown
  misc_feature (373)..(373): n = unknown
  misc_feature (376)..(376): n = unknown
  misc_feature (492)..(492): n = unknown
ttttttttttttttttttttttttttattncanaangcttctatatttatatattttaaataatcagaaattactatagttaatgacnttttgtttgggctccttacataaaatacaattttatacattttaatttttatacatattttttatatttaattgcacagatcatttgggtatttattatattaattgactactttatgataatttgaatcctaattagtctattcaagattgntttcctggtttaagccttacttagcaatctcacttttgcattcttcgccgggtggcgngggtatgcatcgcaactccgttttatcaaagtgcaagccatttggacaatcataatgntttatttgccatttgntgntaaccaagaaacattgataatattttttacaatctcttcgatcggaaaaaacgttttcacttttgcatgcagttctgcacgagaaagattttggggcaaaccattcggtggcgcgncttcacatttca

SEQ ID NO: 1613 - DNA, 416 bp, Ctenocephalides felis
  misc_feature (48)..(48): n = unknown
  misc_feature (135)..(135): n = unknown
  misc_feature (342)..(342): n = unknown
  misc_feature (364)..(364): n = unknown
  misc_feature (388)..(388): n = unknown
  misc_feature (400)..(400): n = unknown
atctgaattttttttgttaaattatttttaatgttataaatcataggnatatttatttccaagttgcaaatatggaaactaccatccctatattatatataattgtatatattcctgaactgttttatttgaatntattttaaacacaaactttaattatattcaaataatgatggacgtgatttcatatatccctaaactttggatcagagtttgagagaagcctagccatagtgtatagaaaattatgtgtaggtgtataattaagattgcaggagtcaaatatataaagcattgatacaaattatacattccaattttctgtaaaccgtgttctttggntgattatgggttatatcacaanttatgaatcatgtaaattaattgnaatttgaaatgnatctccgatgtaaatg

SEQ ID NO: 1614 - DNA, 328 bp, Ctenocephalides felis
  misc_feature (58)..(58): n = unknown
  misc_feature (95)..(95): n = unknown
  misc_feature (127)..(127): n = unknown
  misc_feature (136)..(136): n = unknown
  misc_feature (161)..(161): n = unknown
  misc_feature (201)..(201): n = unknown
  misc_feature (210)..(210): n = unknown
  misc_feature (280)..(280): n = unknown
  misc_feature (317)..(317): n = unknown
ctatatttatatattttaaataatcagaaattactatagttaatgacattttgtttgngctccttacataaaatacaattttatacattttaatntttatacatattttttatatttaattgcacanatcatttgngtatttattatattaattgactacnttatgataatttgaatcctaattagtctattcaagattgntttcctggnttaagccttacttagcaatctcacttttgcattcttcgccgggtggcgtgggtatgcatcgcaactccgntttatcaaagtgcaagccatttggacaatcataatgntttatttgcca

SEQ ID NO: 1615 - DNA, 502 bp, Ctenocephalides felis
  misc_feature (32)..(32): n = unknown
  misc_feature (139)..(139): n = unknown
  misc_feature (188)..(188): n = unknown
  misc_feature (237)..(237): n = unknown
  misc_feature (325)..(325): n = unknown
  misc_feature (341)..(341): n = unknown
  misc_feature (387)..(387): n = unknown
  misc_feature (411)..(411): n = unknown
  misc_feature (432)..(432): n = unknown
  misc_feature (458)..(458): n = unknown
cattgcaccaagcataaattgatgggtccggngcataggttataaaagaattgggatttgcgcatttcatgacggggcaatcagcttctggcgatttctttttacacatatttttagaatgatcatatcatagttaggngggcattcgaaaacctgcctttaccatctttgcagaataagtatcttgngcagctttcggatctggctgatatcctacaaccgccatgtagtttctgncgcttacaggttttcccaggttttgatgagccatatcatctacacaaaatggagcatcggaatttgagtctctgcaattgattggtgnaaatgggggttcttgntcagcgcacaacttcaaaagtagaacaatcgtgacaaaatgttccnactgttattagtaccttcggccgngacacgcctaaccgaatctgnagatattcatacacttgcgggcggtngagcatgcattagaaggcccattcgcctattagggagcgtttac

SEQ ID NO: 1616 - DNA, 346 bp, Ctenocephalides felis
  misc_feature (144)..(144): n = unknown
  misc_feature (203)..(203): n = unknown
ttttttttttttttttttaattgataaattttatttaaaacttgcaaaaattatttaaacaatttacgcatagcacatttcgctcgtgcaaatctcttcctcgcattccagacaagtttccttatcgcatttgtaggtgtcggngcagcctctcttcactttatctcgtcaatatctaagtagcatttgcccatgcatttggncttcgtctcgactttttcagggtcgcaaggcaattttcatcattttcatcacaagaaacacattcgtgttttttggcatcaccattgcattcgtttttgtcacaaggtgggcaacgttctgggtttttctcgcacattttttt

SEQ ID NO: 1617 - DNA, 270 bp, Ctenocephalides felis
  misc_feature (214)..(214): n = unknown
  misc_feature (216)..(216): n = unknown
cataccacaagtattaatttagagtagagtatatttcagtaaaaaaaaaaaattaaattcattatgaaagttggtatgcactttcttaattaaatttactgctaaataaagtttatatttatattaaattacaattaggactacataatgcactttaaaaattatggcatagttaagacttcattagaaatacaataagctacaattataaatngnattatattttgtatttttatcataaaagaataaaatcattcagaatgcaaaaaa

SEQ ID NO: 1618 - DNA, 366 bp, Ctenocephalides felis
  misc_feature (75)..(75): n = unknown
  misc_feature (77)..(77): n = unknown
  misc_feature (92)..(92): n = unknown
  misc_feature (112)..(112): n = unknown
  misc_feature (114)..(114): n = unknown
  misc_feature (183)..(183): n = unknown
atcaagttaatcttgaacataattaaataaactttttgtcaaaaactacagtgaaaataataaaaacatttcatntnaatgtaaacaaaatngatgatcattgataattctngntaaatgtgcttttttaaagcaaatttatttacatattaaacatctgtgaattttgataatttatctcgnagcatcatgttttctttcttcattcgctcaagctcttggcgaagaccaatattctccttctccaagtatcctgcacgtaaggctatttgattttctttcatgcgtcgagcatctcgagatcgcttggctgccatgttattctttctcctcctagcccaatacttatcatccttcaaattatca

SEQ ID NO: 1619 - DNA, 405 bp, Ctenocephalides felis
aacacatttccaaacaaattgctgaggataaacgttacaaaggtatcatcgattgctttgtacgtatccctaaggagcagggccgtactttccttctggcgtggtaacttggccaatgtcattcgttatttcccaactcaggctttgaactttgcattcaaagacaagtacaagcaagttttcttgagtggagttgacaagaagacccaattctggcgttacttcgcaggaaacttggcatctggtggtgctgctggagccacatcattgtgcttcgtctacccacttgattttgcccgtaccagattggccgctgatgtaggtaaaggcgctggtcaacgtgaattctctggattgggcaaccgcttgaccaaaatcttcaagtctgatggtctccctggattg

SEQ ID NO: 1620 - skipped

SEQ ID NO: 1621 - DNA, 475 bp, Ctenocephalides felis
  misc_feature (39)..(39): n = unknown
  misc_feature (41)..(41): n = unknown
  misc_feature (60)..(60): n = unknown
  misc_feature (84)..(84): n = unknown
  misc_feature (109)..(109): n = unknown
  misc_feature (124)..(124): n = unknown
  misc_feature (193)..(193): n = unknown
  misc_feature (198)..(198): n = unknown
  misc_feature (279)..(279): n = unknown
  misc_feature (281)..(281): n = unknown
  misc_feature (360)..(360): n = unknown
  misc_feature (432)..(432): n = unknown
  misc_feature (470)..(470): n = unknown
tttttaagatatatttgctaatgtccatttgctttattngngggctcatttgaagcaaanattatggatcgttaatagcaattnttttaagctcattcataaatactgnataattatttcattntttatcgccttttattattgaaatgcccacaacaagtatacattcaaaatcaaactatatgggattagnagtanataaataattatttacttctactaattaatattggcgaattcatattctatttccatccctatcccttttttataaatcgngnttcaataatttacctcaaaatgagatctaaaatatgaagaaatgatatacaatttcatctatacttatattttaaaagngcacaattaataataaaaagattattttactctcgttcttgagaattgagatttggtctttggcaatcacgnaacaatattctgaactttcatagcttttaatataagtnaaagt

SEQ ID NO: 1622 - DNA, 425 bp, Ctenocephalides felis
  misc_feature (59)..(60): n = unknown
  misc_feature (269)..(269): n = unknown
  misc_feature (347)..(347): n = unknown
  misc_feature (350)..(350): n = unknown
gatcggttgcaatttgtcattgcaccaagcataaattggatgggtccggtgcataggtnntaaaaagaattgggatttgtgcatttcatgacggtgcaatcaagcttctgacgatttctttttacacatatttttagaatgatcatatacatagttaggtgggcattcgaaaacctgacctttaccatcttgcagaataagtatcttgtgcagtctttcggatctggctgatatcctacaaccgcgcatgtagtttctgccgcttacangttttccccaggttttgatgagcacatatcacctacacaaaatggagcatcggaatttgagtctctgcaattgattgntgnaattggggtttcttgtcagcgcacaacttcaaaagtagaacaatcgtgacaaaatggtcccaactgcttattagt

SEQ ID NO: 1623 - DNA, 445 bp, Ctenocephalides felis
  misc_feature (18)..(18): n = unknown
  misc_feature (33)..(33): n = unknown
  misc_feature (37)..(37): n = unknown
  misc_feature (53)..(53): n = unknown
  misc_feature (55)..(55): n = unknown
  misc_feature (61)..(61): n = unknown
  misc_feature (88)..(89): n = unknown
  misc_feature (103)..(103): n = unknown
  misc_feature (116)..(116): n = unknown
  misc_feature (132)..(132): n = unknown
  misc_feature (145)..(146): n = unknown
  misc_feature (167)..(167): n = unknown
  misc_feature (184)..(184): n = unknown
  misc_feature (251)..(251): n = unknown
  misc_feature (326)..(326): n = unknown
  misc_feature (351)..(351): n = unknown
  misc_feature (361)..(361): n = unknown
  misc_feature (377)..(377): n = unknown
tacgcgactcataaatanttatttaaacaatgnatgntaaaaaaaattaaagntngggaanataatatatgtattggattaacttagnnaattctccctcgcncttttatactatngtaaccagaaacaaanatcagagtgtgtnnaacgtaaattcatatattttnggtaaaatacaatcaanatataacagtgcccaatattattaaaatacgtatttgtgacgaaacctaaagtgtcgtcagaatatnaaaaacaataatatttataccttcaaatgtatgctttgaaaaaaagcattcgaagattttgtttaaatattttgntaagtccacatttatgtttggtcgntcaattaaantatgtttcttttgcangtaagattatgttgtagatattgtcacaaaattagtatattttatgttattttaagcatattggtatt

SEQ ID NO: 1624 - DNA, 484 bp, Ctenocephalides felis
  misc_feature (390)..(390): n = unknown
  misc_feature (419)..(419): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgnattttatgtaaggagcacaaacaaaatgncattaactatagtaatttctgattatttaaaatatataaatatagaagctttatgaaattggaaa

SEQ ID NO: 1625 - DNA, 392 bp, Ctenocephalides felis
  misc_feature (50)..(50): n = unknown
  misc_feature (77)..(77): n = unknown
  misc_feature (319)..(319): n = unknown
gcataaattgatgggtccggtgcataggttataaaagaattgggatttgngcatttcatgacggtgcaatcagcttntgacgatttctttttacacatatttttagaatgatcatatacatagttaggtgggcattcgaaaacctgacctttaccatcttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgnaattggggtttcttgtcagcgcacaacttcaaagtagaacaatcgtgacaaaatgtcccaactgcttattagt

SEQ ID NO: 1626 - DNA, 598 bp, Ctenocephalides felis
  misc_feature (161)..(161): n = unknown
  misc_feature (461)..(461): n = unknown
  misc_feature (485)..(485): n = unknown
  misc_feature (492)..(492): n = unknown
  misc_feature (556)..(556): n = unknown
  misc_feature (559)..(559): n = unknown
  misc_feature (586)..(586): n = unknown
aacatttcagactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggngtcatagaatcaaagtatgctgcacggtagatgatgataccttgaacagatactccaaaaccacggtacaatccagggagaccatcagacttgaagattttggtcaagcagttgcccaatccagagaattcacgttgaccagcgcctttacctacatcaagcggccaatctggtacgggcgaaatcaagtgggtagacgaagcacaatgatgtggcttcagcagcaccaccagatgccaagttttctgcgaagtaacgccagaattgggtcttcttgtcaacttcacccaagaaaacttnttgtacttgctttgaatgcgaagntcaaagnctgagtgggaaatacgaatgacattggccaagtaccacgccagaaaggaagtacgccctgttcntanggatacgtacaaagcaatcgatgatancttttgtacgtt

SEQ ID NO: 1627 - DNA, 232 bp, Ctenocephalides felis
  misc_feature (6)..(6): n = unknown
  misc_feature (48)..(48): n = unknown
  misc_feature (65)..(65): n = unknown
  misc_feature (120)..(120): n = unknown
  misc_feature (160)..(160): n = unknown
  misc_feature (216)..(216): n = unknown
tttggnttactttatgtgttatataaaaaaatattatggttgaacacnggctcgcaaatatgatnaggggatttaagaattttacaatttagatttttttaaatccatgaatatatttgntctaatcaaaattattcattttacgcttaattttattggntgaactaatagatagatagataaagatatagagtcaatataaaaatgaagaaaatnaaattaaaagtggaca

SEQ ID NO: 1628 - DNA, 404 bp, Ctenocephalides felis
  misc_feature (133)..(133): n = unknown
tctccaatatcaaagcaggctacagacagaacaaggggatcacgagagctttcaagtaagtggatcaatatacgcaataactcataattcttctcattgagacgtggggcattctctctccagaacttagcanatttgtgaacaggtgaccattccaatctgccggacttgatttctgtagcatattcatcaaatgagctaaggtcttgaatggaagcttgtaatttttcggtcaaatattcaacatcagcaacgatatcctcatcatctgaacgtctttgttccaggatggataattgtttcaataccttgctttgcaccattgcaatgcaatgctccttggccacctgttgatctttcactttctcaattaaattcctataaacagccagtacccctcgcgg

SEQ ID NO: 1629 - DNA, 159 bp, Ctenocephalides felis
  misc_feature (41)..(41): n = unknown
agtttgtcataagtttccttgttgaacaagacctggttgtntaacttgtcacgtacttttcctttggaccacttcttctttttggctttgccacctccggaaccctctttcttcttttgggtcttttgtggctgtttagccgaagactttgaatccttc

SEQ ID NO: 1630 - DNA, 497 bp, Ctenocephalides felis
  misc_feature (33)..(33): n = unknown
  misc_feature (187)..(187): n = unknown
  misc_feature (354)..(354): n = unknown
  misc_feature (397)..(397): n = unknown
  misc_feature (455)..(455): n = unknown
gcactgtagatatccactttgatcagcgcacanttgatctgggctacaggattccttaaccggatctgctcctatttccggacaatactgcatttcgggtgaactgcacgaattcacgcaactaaattttacttttttacatttttgcaatataatacatatatattataaaaaagtaaaaaatcgntattaaaataattaattacacgggatatattagatagttaattttataataaattgtattatataatagggaatataatacatatatattataaaaagtaaaaaaatcgttattaaaataattaattacacgggatatattagatagttaattttataataaattgnattatataatagggaatataatacatatatattataaaaaagnaaaaaatcgttattaaaataattaattacacgggatatattagataggtaattttatnataaattggattatataataggggatataatacaaaaaaaaa

SEQ ID NO: 1631 - DNA, 386 bp, Ctenocephalides felis
  misc_feature (31)..(31): n = unknown
  misc_feature (60)..(60): n = unknown
  misc_feature (183)..(183): n = unknown
  misc_feature (360)..(360): n = unknown
cctacacaactcagggcaatggcagtatgtntatctttaatgatgggtcgattaggaagngttgttggaagcaatgttgtaggaataattctagattataattgcgatttaacatttttaatatcaggaacatctctgatagcatgtggagtgattgcattctttataccgaacatttatcanaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgntattagattcgatgtaagatatatgt

SEQ ID NO: 1632 - DNA, 427 bp, Ctenocephalides felis
  misc_feature (47)..(47): n = unknown
  misc_feature (349)..(349): n = unknown
  misc_feature (398)..(398): n = unknown
cgccctaaagctgccaactcgaacttgaacttgcttttcgttgcggncatttttgaagcattgagcagcagtgagaacaaaatatctactaactatgactcctccacaaatatggtcacctctatataaaacagatgccacgtaaggtaattcgctgatgtcagcaggttttcctccgatcatacgagaatcggtcaaatttttgctttctgcccctgaaaagatgaatagtagtaatatattaatcatggaaaaacttttgtatgtattacaaaataactgctaattaaaaatttagatttgttattggaacattcaatttgttcatagataaattttattacattgnaaaatttgataagggttcattccatatcacaaatttttacaatggctgnaactgggcagcctttttattttatttagt

SEQ ID NO: 1633 - DNA, 438 bp, Ctenocephalides felis
  misc_feature (144)..(144): n = unknown
  misc_feature (208)..(208): n = unknown
  misc_feature (220)..(220): n = unknown
tcctggccaagaaacaagattggattgtaatacttgcaaatgcgccagtgatggaacaggttacttttgcacccgccaagcatgtgctccagttcaccatcataaacgatcagctgaagaagtgaaagaagtgactacaacttntttggcaacgactccatgcactcctggagagaagactcaaattgattgtaatacttgcacctgngccagggatggntctggatacgcctgcactcgcaaaatgtgtttgccagccacccacgatcgtcgacgtagagaagctgaaactgaagaagtcaaagaagttacaactgatactttggcaaccactccatgcaaagctggcgagcaaagacaagtggactgcaacacctgcacctgtgctgctgatggaactggatatcaatgcacccgccaagcttgtgagtttgcagt

SEQ ID NO: 1634 - DNA, 252 bp, Ctenocephalides felis
  misc_feature (195)..(195): n = unknown
  misc_feature (245)..(245): n = unknown
tacaaaattagtgctaattcaaaaacacttacagacctttgaaaatcaatttttaacaataatttacttttttataacttctttataactaatttgtttttttaatttatttaaataatagataaattgattattctgcttccttatcctccgcgtccaaaatagttttgaagcaaaaggggtgggaccaaatancccaaaccagagtagaccttactcatgaactccacccagtgaaacgcagnggtgcaa

SEQ ID NO: 1635 - DNA, 444 bp, Ctenocephalides felis
  misc_feature (60)..(60): n = unknown
  misc_feature (136)..(136): n = unknown
  misc_feature (286)..(286): n = unknown
  misc_feature (331)..(331): n = unknown
  misc_feature (339)..(339): n = unknown
  misc_feature (356)..(356): n = unknown
  misc_feature (377)..(377): n = unknown
  misc_feature (402)..(402): n = unknown
  misc_feature (415)..(415): n = unknown
  misc_feature (420)..(420): n = unknown
  misc_feature (432)..(432): n = unknown
aggtgcgttacatatctgaattttttttgttaaattatttttaatgtaataaatcatagnaatatttatttccaatttgcaaatatggaaactaccatccctatattatatataattgtatatattcctgaattgntttatttgaatttattttaaacacaaactttaattatattcaaataatgatggacgtgatttcatatatccctaaactttggatcagagtttgagagaagcctagccatagtgtatagaaaattatgtgtaggtgtataattaagattgncaggagtcaaatatataaagcattgatacaaattatacatcccanttttctgnaaaccgggttctttggntgattatgggttatatcacancttatgaatcatgtaaattaattgnaaatttgaaatgnatctncgatgtaaatgntaaaaaaaaaaa

SEQ ID NO: 1636 - DNA, 86 bp, Ctenocephalides felis
  misc_feature (13)..(13): n = unknown
aacaaacccccangcgcccgtgcccgtgtcgctttgactggattaactgtagctgaatacttccgtgaccaggaaggacaagatgt

SEQ ID NO: 1637 - DNA, 263 bp, Ctenocephalides felis
  misc_feature (23)..(23): n = unknown
  misc_feature (46)..(46): n = unknown
  misc_feature (210)..(210): n = unknown
  misc_feature (249)..(249): n = unknown
ctagcagtcttataaaatacagntcaacaattcttatcttatcagngctttctaaaataacatacataatttaaatcaaaattaaatacgagtaacaaaagtagtaaacaaatagaattagttctaatcttcttacacctaaaaactattttagataaattgagtagatcgccattttcttttaatttaataaattcttttttatgatgnattaaatattcatatatcgcttatttaaatgtttccggnatcttataatttgt

SEQ ID NO: 1638 - DNA, 498 bp, Ctenocephalides felis
  misc_feature (29)..(30): n = unknown
  misc_feature (59)..(59): n = unknown
aaggaatgttccagcttatggagcccaanntattattgaaggtccgcaaagctggtttngatttggtagaatcagttttaactgatgccatggatcagtataaacaacagatggttaccaaagaagttgtcgccactatcaatagggaagcatttttgccagtagaatgctgcggtggagttgaattgagtggacttaatggccgcattaaggtttcaaacacattggaatcccgtttggacttgattgctcaacaattgattccagaaatccgaactgccttattcggaagcaatgccaaccgtaaattcacagactaaatattcatatcaaattacatgattaggatgcaaagtgacctagattcgtattagtaaaaagcatcaagatcaaaatgaatgcacaatcagattcataatgagtgtttttgcatgatacacattttttcagacaatagttcatataattgatgcttcactttgcttcatagtcctattt

SEQ ID NO: 1639 - DNA, 486 bp, Ctenocephalides felis
  misc_feature (34)..(35): n = unknown
  misc_feature (45)..(46): n = unknown
  misc_feature (48)..(48): n = unknown
  misc_feature (115)..(115): n = unknown
  misc_feature (144)..(144): n = unknown
  misc_feature (191)..(191): n = unknown
  misc_feature (291)..(291): n = unknown
  misc_feature (309)..(309): n = unknown
  misc_feature (328)..(328): n = unknown
  misc_feature (373)..(373): n = unknown
  misc_feature (409)..(409): n = unknown
  misc_feature (413)..(413): n = unknown
ttttttttttttttttttttaatacacatgaacnntgctatattnngntattttaaataatcagaaattactatagttaatgacattttgtttgtgctccttacataaaatacanttttatacattttaatttttatacatatnttttatatttaattgcacagatcatttgtgtatttattatattaatngactactttatgataatttgaatcctaattagtctattcaagattgttttcctggtttaagccttacttagcaatctcacttttgcattcttcgccgggnggcgtgggtatgcatcgnaactccgttttatcaaagngcaagccatttggacaatcataatgttttatttgccatttgttgntaaccaagaaacattgataatattttttacaatctnttcnatcggaaaaaacgttttcacttttgcatgcagttctgcacgagaaagattttgggtcaaaccattcgttgacg

SEQ ID NO: 1640 - DNA, 500 bp, Ctenocephalides felis
  misc_feature (26)..(26): n = unknown
  misc_feature (52)..(52): n = unknown
  misc_feature (55)..(55): n = unknown
  misc_feature (72)..(72): n = unknown
  misc_feature (133)..(133): n = unknown
  misc_feature (190)..(190): n = unknown
  misc_feature (291)..(291): n = unknown
  misc_feature (335)..(335): n = unknown
  misc_feature (351)..(351): n = unknown
  misc_feature (372)..(372): n = unknown
  misc_feature (401)..(401): n = unknown
  misc_feature (425)..(425): n = unknown
  misc_feature (488)..(488): n = unknown
  misc_feature (495)..(495): n = unknown
tttttttttttttttttttttttttngacggcccaaacgatttatttttatnggnaagatacatgtaatttnataaagcttctatatttatatattttaaataatcagaaattactatagttaatggcatttngtttgtgctccttacataaaatacaattttatacattttaatttttatacatattcnttatatttaattgcacagatcatttgtgtatttattatattaattgactactttatgataatttgaatcctaattagtctattcaagattgttttcccggnttaagccttacttagcaatctcacttttgcattcttcgccgggnggcgtgggtatgcatngcaactccgttttatcaaagngcaagccatttggacaatcataatgtttnatttgccatttgttgttaaccaanaaacattgataatattttttacaatctcttcgatcggaaaaaacgttttcacttttgcatgcngttctgnacgag

SEQ ID NO: 1641 - DNA, 500 bp, Ctenocephalides felis
  misc_feature (113)..(113): n = unknown
ttttttttttttttttttttttttttttttagaaaataaaattatttattttatgggaatgcaggcagcatttgcacacatttgtgtgaatataaaacattaataaaattatntgcataacaatatttttacaaatctactacaatcaatatttcaactatatacaatgattattaaaaattgaagattcctattttatgaaaaatagtttggaacagatttaaattacttagtcatttctttcattctgtttaatgcactgccagctttgaaccatccaatttgcaaatcgttcaacgtgtgtttcagtaagattttatcgacttttccatcagcatgtttgatctcacactcaacaggctttccagcactaagtttgtccaaacctaacaagctgattttgtcagttggttgaatcttgtcataatctcctggtgtggcaaaagtcagtggcaacattccttgctttttcaagttagtttcatgtatacgtgcaaaag

SEQ ID NO: 1642 - DNA, 232 bp, Ctenocephalides felis
  misc_feature (29)..(29): n = unknown
aaagtgatttaccagagaagtttgtgaantacttgggtgtcctcaacgctttatctgacaaagttttggaactaacccctgatgagcgccctagcctgttcttcttccgcttatcaacaaatttcaaatcccccgaagacaccgacaaagccaaaacagagctcaccaaagccatcaaaactttaagcgaagccttcgacaaaacctacaaaggcaaagtgctgtttacagt

SEQ ID NO: 1643 - DNA, 414 bp, Ctenocephalides felis
  misc_feature (26)..(26): n = unknown
  misc_feature (45)..(45): n = unknown
  misc_feature (56)..(56): n = unknown
acacaattagcaataggaaaatctantttcaaatatttttaacantttatttaatnggttatgttctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatataaataacggt

SEQ ID NO: 1644 - DNA, 497 bp, Ctenocephalides felis
  misc_feature (27)..(27): n = unknown
  misc_feature (29)..(29): n = unknown
  misc_feature (56)..(56): n = unknown
  misc_feature (59)..(59): n = unknown
  misc_feature (212)..(212): n = unknown
  misc_feature (214)..(214): n = unknown
  misc_feature (487)..(487): n = unknown
ttttttttttttttttttttttaacgntncaaacgatttatttttattaaaaaganggnatgtaatttcataaagcttctatatttatatattttaaataatcagaaattactatagttaatgacattttgtttgtgctccttacataaaatacaattttatacattttaatttttatacatattttttatatttaattgcacagatcattngngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgcttccttttgcatgcagatntgcacgagaa

SEQ ID NO: 1645 - DNA, 350 bp, Ctenocephalides felis
  misc_feature (58)..(58): n = unknown
  misc_feature (60)..(60): n = unknown
  misc_feature (216)..(216): n = unknown
acaaaggatataatcctagtaacagttatttcaacgacattgcacttctcaagctatngngaacccttaaaatatagtaaatttgcgcaaccagttactttgccagaagccaatgaacaaactaaacacaatgcatcagctacgcttgtcggatggggaataaattctactaccgacggagttttgcaaacacatctccaagaattgcactaccanatcgtcggatccaaggaatgtggtgatttgcactttagacccatttataaagagcaaatttgcgcagcttatccagattatgacagagcacaatgcagtggagattctggaggtccattgaccgtagatgaggt

SEQ ID NO: 1646 - DNA, 335 bp, Ctenocephalides felis
  misc_feature (34)..(34): n = unknown
aagaacactatacgtgcgaaaactgagaataaanctcccgctaaaaatactgttctactgctgactttaacacaagcagtcattcctgccaaaaacatccttgatggcaaatctgcagctgctgcggcagatacacaaattgctgtatcagtctttgaccagcctaatgcaaacagatacattgtttgaatagcagaaaatgctatgtcggagtatagtgcaaatgtcactccaataaccatatttacataaatccagtcttttaacaaagtcaaatccaaaaagtcaacgataacttgcaattttcccctagatttcttctctaccggtgcagt

SEQ ID NO: 1647 - DNA, 482 bp, Ctenocephalides felis
  misc_feature (58)..(58): n = unknown
  misc_feature (433)..(433): n = unknown
tgaaatgtgaagacgacgtcaacgaatgttttgacccaaaatctttctcgtgcagaantgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagnaatttctgattatttaaaatatataaatatagaagctttatgaaattaa

SEQ ID NO: 1648 - DNA, 498 bp, Ctenocephalides felis
  misc_feature (20)..(20): n = unknown
  misc_feature (55)..(55): n = unknown
  misc_feature (58)..(58): n = unknown
  misc_feature (63)..(63): n = unknown
  misc_feature (76)..(76): n = unknown
  misc_feature (78)..(78): n = unknown
  misc_feature (455)..(455): n = unknown
gacaaactaggaattatagngtctattttaacctataaaatacttattcttaatnggntaaantaactttcgactnanttttaaataaaatatcaatataaaggaattgaatcctttaatttttgcaaatgtaaattttgtatttatttagccaaaatttggagatctgtgtgttttaggaataaccagaacaatttactattcgtatagtaaatatcatttgctacatataaaaatactctatattatacatactctgttcatttatttaattttggtgacaatagtccgattttccaaaaaataacaatatgcttaaaattacataaaatatactaattttgtgacaatatctacaacataatcttacttgcaaaagaaacataatttaattgaacgaacaaacataaatgtggacttaacaaaatatttaaacaaaatcttcgaatgctttntttcaaagcatacatttgaaggtataaatattattgcttttta

SEQ ID NO: 1649 - DNA, 498 bp, Ctenocephalides felis
  misc_feature (26)..(26): n = unknown
  misc_feature (326)..(326): n = unknown
  misc_feature (484)..(484): n = unknown
aacatttctgactttgcacgtccagnttgcatcatcatacgcctacggacagtgtggaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggtacaatccagggagaccatcagacttgaagattttggtcaagcagttgcccaatccagagaattcacgttgaccagcgcctttacctacatcagcggncaatctggtacgggcgaaatcaagtgggtagacgaagcacaatgatgtggctccagcagcaccaccagatgccaagtttcctgcgaagtaacgccagaattgggtcttcttgtcaactccacccaagaaaacttgcttgtcttgtctttgaatgcgangtcaaagcctgagt

SEQ ID NO: 1650 - DNA, 500 bp, Ctenocephalides felis
  misc_feature (60)..(60): n = unknown
  misc_feature (109)..(109): n = unknown
  misc_feature (114)..(114): n = unknown
  misc_feature (124)..(124): n = unknown
  misc_feature (213)..(213): n = unknown
tttttttttttttttttttttttcattttttaccacgccatctcggcaagccatggtggncagcaaatgagtaaacacacagtcaaggcatggaaacatattatgtagntgtgngttgcatctngaataaacccaacgattggacccaaagccaatgtcattattccttgcaagaacatgaacagcccgtatgccgaaggaaatctctcctgngaaaaatattcggcaaatactaaaggtaaaggcacatgaatccatgtgcggaagaatcccaaaaaacttgatattataagcatcattgtaaagtcagtcacgtacaagaacactatacgtgcgaaaactgagaataaagctcccgctaaaaatactgttctactgctgactttaacacaagcagtcattcctgccaaaaacatccttgatgacaaatctgcagctgctgcagcagacacacaaattgctgtatcagtctttgaccagcctaatgcaaacagatacat

SEQ ID NO: 1651 - DNA, 486 bp, Ctenocephalides felis
  misc_feature (33)..(33): n = unknown
  misc_feature (63)..(63): n = unknown
tgaaatgtgaagacgacgtcaacgaatggtttntcccaaaatctttctcgtgcagaactgcangcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaaaaaaaaaa

SEQ ID NO: 1652 - DNA, 498 bp, Ctenocephalides felis
  misc_feature (29)..(29): n = unknown
  misc_feature (56)..(56): n = unknown
  misc_feature (430)..(430): n = unknown
  misc_feature (441)..(441): n = unknown
  misc_feature (457)..(457): n = unknown
  misc_feature (479)..(479): n = unknown
ccatgacctcctgtgaaataacttacttnatacccaattgctatcaccaaccaggngccaatcatcgaatagtacataaaaccaattcggtaaggtgcaataacttcatcatttgaatgcccatcgtgatgctgggtcttccatacagaattcacagtcgtatttttaccctcaggacaaccttcagtcgacatatttaggtaaggaaacttcaaattaccttgagcaatgttaatttgggctccacttaccatccaactgaccaggattagacttgctgcagctcccaccaaaactccctttgtgtttgctttagggaacaagattcccaatgtaaacattcccaaaagggttcctgcagtaactccagtgacactaatgaccaaatgcatgacgcttctaattggtctactacaaagacaagtccgangcaaattcctncaattactactacagncagcttcataatattactgggngtcttttacttagtggtaa

SEQ ID NO: 1653 - DNA, 500 bp, Ctenocephalides felis
  misc_feature (31)..(31): n = unknown
  misc_feature (60)..(60): n = unknown
  misc_feature (63)..(63): n = unknown
  misc_feature (79)..(80): n = unknown
  misc_feature (87)..(87): n = unknown
  misc_feature (184)..(184): n = unknown
  misc_feature (267)..(267): n = unknown
  misc_feature (291)..(291): n = unknown
  misc_feature (309)..(309): n = unknown
  misc_feature (446)..(446): n = unknown
  misc_feature (448)..(448): n = unknown
aacggcccaaacgatttatttttattaaaantttacatgtaatttcataaagcttctatnggnatatatttaaaataannagaaatnactatagctaatgacattttgtttgtgctccttacataaaatacaattttatacattttaatttttatacatattttttatatttaattgcacagancattagtgtatttattatattaattgactactttatgataattggaatcctaattagtctattcaagattgttttcctggttnaagccttacttagcaatctcactnttgcattcttcgccgggnggcgtgggtatgcatcgcaactccgttttatcaaagtgcaagccatttggacaatcataatgttttatttgccatttgttgttaaccaagaaacattgataatattttttacaatctctttcgatcggaaaaaacgntntcactttagcatgcagttctgcacgagaaagattttgggtaaaaccattcgt

SEQ ID NO: 1654 - DNA, 492 bp, Ctenocephalides felis
  misc_feature (489)..(489): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattaaaaaaaanaaa

SEQ ID NO: 1655 - DNA, 498 bp, Ctenocephalides felis
  misc_feature (59)..(59): n = unknown
ataaaaaaaatcacaataaatagatagttttaacacctatcaacttaaaattatgtganacaagcttaaactttgcgtattatgtaaaattaaaatatacaaaaaatatactttgagtaaatatgttgtcaatgatatatcattgatatagaaggctttttatcagctttttataaatttcgataacacagatattgataaataaattacatgtgacccggcaatgcttgaggtccctgcataaatatatttgaccccattcgctgctgatattgcacactttgttgggattcatcgttaggattagaatggcttgatgcaggtatggttcccatgccatttgtaatatgcaatccatttaaatgttgagacatttgatgtattaacataggattagggcctggttgtggttgtcctattggttgaggattattcgctagggacatttgagaactgttctgaatcaattgcatttgtggctgactttgatttactatt

SEQ ID NO: 1656 - DNA, 177 bp, Ctenocephalides felis
  misc_feature (27)..(27): n = unknown
  misc_feature (29)..(29): n = unknown
aaccaactagagctaagaaaaaagccntngatagcatagaactgctatgttcccctgcaaataccactgttgttttatcatataaaaatgccataagtatggagctaatgcatccaatcaccatcaatatatatatatatgaagagtcttttatccttcctgggtaaagttttctgt

SEQ ID NO: 1657 - DNA, 498 bp, Ctenocephalides felis
  misc_feature (485)..(485): n = unknown
aacatttctgactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggtacaatccagggagaccatcagacttgaagattttggtcaagcagttgcccaatccagagaattcacgttgaccagcgcctttacctacatcagcggccaatctggtacgggcgaaatcaagtgggtagacgaagcacaatgatgtggctccagcagcaccaccagatgccaagtttcctgcgaagtaacgccagaattgggtcttcttgtcaactccacccaagaaaacttgcttgtacttgtctttgaatgcgangttcaaagcctga

SEQ ID NO: 1658 - DNA, 365 bp, Ctenocephalides felis
  misc_feature (34)..(34): n = unknown
tttctttagtggtgcactgtagatatccactttnatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaacattctaataaatatgttacccagc

SEQ ID NO: 1659 - DNA, 256 bp, Ctenocephalides felis
  misc_feature (58)..(59): n = unknown
cggcgacaaaacacttgaagataaattttttgaacatgaggttcatctcaatgtgtgnngctttcttgcaacaattccatttcggagtattttactcttatttgaaactcaaggaacaagagtgccgtaacattgtttggataagtgagtgcgttgctcaaaagcacaggaccaagattgacaactacattccaatattttaattaatttgttgttaattttgataacgttgattttatccagatgtttgttgtgt

SEQ ID NO: 1660 - DNA, 500 bp, Ctenocephalides felis
  misc_feature (31)..(31): n = unknown
  misc_feature (106)..(106): n = unknown
  misc_feature (117)..(117): n = unknown
  misc_feature (119)..(119): n = unknown
  misc_feature (121)..(121): n = unknown
  misc_feature (140)..(140): n = unknown
  misc_feature (174)..(174): n = unknown
  misc_feature (240)..(240): n = unknown
  misc_feature (266)..(266): n = unknown
  misc_feature (452)..(452): n = unknown
  misc_feature (488)..(488): n = unknown
ttttctttttttttttttttttttttttttnttttattgcatcaactacattggggttaaacaaaggaagaactattattcttaaattaaagggaaattttacatnatacattcaanangnatcaattctaaaattatgngaataaccaaaattttaaaccattaacacaaatnttttttattcccacttaacttattacttattaaaatattacttggcaagtatttttatatttttgnatttttttaggtatattataaagacncctttagttgttgccttatgaataaaatacatatttataatacattcacatattatatactaaactattgagaagacttagacgatttaatggaattaatatgaaggaatttattaatttaaattttataaatataaaaaattttagtgctttttttaagatatcctatgttatattataattcgntttcatttacagatgtggcatataggtatattcttngtttaattaatt

SEQ ID NO: 1661 - DNA, 500 bp, Ctenocephalides felis
  misc_feature (56)..(56): n = unknown
  misc_feature (59)..(59): n = unknown
  misc_feature (177)..(177): n = unknown
  misc_feature (311)..(311): n = unknown
  misc_feature (413)..(413): n = unknown
ttttttttttttttttttttttttttgttttcataaagcttctatatttatatatnggnaataatcagaaattactatagttaatgacattttgtttgtgctccttgcataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatngcaactccgttttatcaaagtgcaagccatttggacaatcataatgttttatttgccatttgttgttaaccaagaaacattgataatattttttacaatctnttcgatcggaaaaaacgttttcacttttgcatgcagttctgcacgagaaagattttgggtcaaaccattcgttgacgtcgcttcaca

SEQ ID NO: 1662 - DNA, 425 bp, Ctenocephalides felis
  misc_feature (14)..(14): n = unknown
  misc_feature (29)..(29): n = unknown
agacgttgtcatanatctatcatttactntaaaaacgatgttacgtgcatcgaagacgcaactcttatttcattaaataaaatcacaaacataaatattttaaatacatatatacaagtaaaacatttcttggtctaaataatgccatatactttatgataatattttatattaaaatgtttcattatcaaattactaatcacttacggatgtcaataaacaaatctaaaatgatgatttaacaatatgtttattgttctcttatttctttaaatttatcactaattcttatatctttgatctacaacaaaataaattatcgcatgtaaaataatggagagtaattttcaattttcaagcaagattccatgaaagatttaatttagaattgagatttgaattaacaatgtttagttcagaatagt

SEQ ID NO: 1663 - DNA, 500 bp, Ctenocephalides felis
  misc_feature (37)..(37): n = unknown
  misc_feature (65)..(65): n = unknown
ttttttttttttttttttaattgataaattttatttnaaacttgcaaaaattatttaaacaattnacgcatagcacatttcgctcgtgcaaatctcttcctcgcattccagacaagtttccttatcgcatttgtaggtgtcggtgcagcctctcttcactttatctccgtcaatatctaagtagcatttgcccatgcatttggtcttcgtctcgactttttcagggtcgtcaaggcaattttcatcattttcatcacaagaaacacattcgtgttttttggcatcaccattgcattcgtttttgtcacaagttgggcaacgttctggttttttctcgcacatttttttcagattctggttcttgaacaggttgctggtgcaccctaattttatggcatcaccttgtgcatttaaaatactcaaacaagtatcttgtggcttgagacaaacttccttggcatcatctttagcgttgcaaaccctgcgatttcttgggaaaa

SEQ ID NO: 1664 - DNA, 498 bp, Ctenocephalides felis; identical to SEQ ID NO: 1655
  misc_feature (59)..(59): n = unknown

SEQ ID NO: 1665 - DNA, 500 bp, Ctenocephalides felis
  misc_feature (31)..(31): n = unknown
  misc_feature (34)..(34): n = unknown
  misc_feature (61)..(61): n = unknown
  misc_feature (154)..(154): n = unknown
  misc_feature (203)..(203): n = unknown
  misc_feature (212)..(212): n = unknown
ttttttttttttttttttttttttttccaanttnatttatttttattaaaaagatacatgnggtttcataaagcttctatatttatatattttaaataatcagaaattactatagttaatgacattttgtttgtgctccttacataaaatacanttttatacattttaatttttatacatattttttatatttaattgcacanatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgtttttcacttttgcatgcagttctgcacgagaaag

SEQ ID NO: 1666 - DNA, 414 bp, Ctenocephalides felis
  misc_feature (29)..(29): n = unknown
  misc_feature (32)..(32): n = unknown
  misc_feature (59)..(59): n = unknown
  misc_feature (61)..(61): n = unknown
  misc_feature (166)..(166): n = unknown
  misc_feature (384)..(384): n = unknown
cgttatttatattatattgtttatacagnttngcactgttgtatgaaaagtatctgaangnaacacatctcatgtaaggttactttattgtaaaagttattttatatgtaatttttaataacattaaaattattttgttctttctgttagatgaattgtgtgttanatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattggtaaaaatatttgnggctagattttcctattgctaattgtgtgt

SEQ ID NO: 1667 - DNA, 138 bp, Ctenocephalides felis
ttttttttttgattagaacaaatatatttttggatttaaaaaaatctaaattgtaaaagtcttaaatgccttatcatatttgcgagcctgtgttcaaccataatatttttttatataacacataaagtaaaacaaagt

SEQ ID NO: 1668 - DNA, 386 bp, Ctenocephalides felis
  misc_feature (27)..(27): n = unknown
  misc_feature (58)..(58): n = unknown
atatatcttacatcgaatctaataacnttaaagagttattaattttcatgtcgatggnttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1669 - DNA, 498 bp, Ctenocephalides felis
  misc_feature (58)..(59): n = unknown
aaggctgtcctctacttttggaagtaaattgaatcatatggacatgaatatcaagttnngaaagataaatacacaaataatagattccaatagtaagaattaagtaaaatatgaagccatatgtacatattatattcacaataatctaatcttccaagttgcggaatgcttgctgtaaatcctcatgtaattgatcaaaatcactcttgatctttgcctcaccatccttgactgggtccttgaacttcattgaggacaactgatatagaatattgcccatagcatctctaatggtattccaggtaatcttgttttcactttgtgcagtagattcaactgcgtattttgccatatcatagaaagcaataatgttacgtaacataccaactgttttatagaaggggcagaaacgatcatatgatgagtagctgttctgctgtaggaaatcgtctttcaagagcttggcaacttcaaagtgtgatcttgtcagttttccgc

SEQ ID NO: 1670 - DNA, 425 bp, Ctenocephalides felis
  misc_feature (41)..(41): n = unknown
ttgctgcggattccgcactcactgaacttcagcagcaaggnaatgatgttctcatggttccatttataacaaaatgtcagctgccattggaaagttttcgattgttaaaaaccagcaaagccatagtcaataaaagaagtttgaaatatcagatttttctgttcgagaatttaatactgtttactgaacctactattgtgaacaatgaagagttttttacctgcaaagactatatatctggatagaattttaccacctgtcgaatgtcagaagtctttatatgcatttaccctgacgagttcagaaaataaatctagaattttccatataaaatgctcaagtggcgatgaaagatcgtcctggatgactattattaggaatattttgtttcagcaacaacaggcatggaaagaagcaatgaaaaa

SEQ ID NO: 1671 - DNA, 393 bp, Ctenocephalides felis
tctccaatatcaaagcaggctacagacagaacatggggatcacgagagctttcaagtaagtggatcaatatacgcaataactcataattcttctcattgagacgtggggcattctctctccagaacttagcagatttgtgaacaggtgaccattccaatctgccggacttgatttctgtagcatattcatcaaatgagctaaggtcttgaatggaagcttgtaatttttcggtcaaatattcaacatcagcaacgatatcctcatcatctgaacgtctttgttccaggatggataattgtttcaataccttgctttgcaccattgcaatgcaatgctccttggccacctgttgatcttccactttctcaattaaattcctataaacagccagt

SEQ ID NO: 1672 - DNA, 500 bp, Ctenocephalides felis
  misc_feature (37)..(37): n = unknown
  misc_feature (64)..(64): n = unknown
ttttttttttttttttttaattgataaattttatttnaaacttgcaaaaattatttaaacaatngacgcatagcacatttcgctcgtgcaaatctcttcctcgcattccagacaagtttccttatcgcatttgtaggtgtcggtgcagcctctcttcactttatctccgtcaatatctaagtagcatttgcccatgcatttggtcttcgtctcgactttttcagggtcgtcaaggcaattttcatcattttcatcacaagaaacacattcgtgttttttggcatcaccattgcattcgtttttgtcacaagttgggcaacgttctggttttttctcgcacatttttttcagattctggttcttgaacaggttgctggtgcaccctaattttatggcatcaccttgtgcatttaaaatactcaaacaagtatcttgtggcttgagacaaacttccttggcatcatctttagcgttgcaaaccctgcgatttcttgggaaaa

SEQ ID NO: 1673 - DNA, 498 bp, Ctenocephalides felis
ataaagtatccgttcaatggtaacgtttttcagcaaaccaataattagtaacatctagaaaaggagctgataatgacaaagctgctaaaaaacaggtatgtcttaaagcaactcttctacataatgcaggatcagtaactgccatcattctatacccagctctactgtaatccggtcttaaattccaagataatgcattaaaatgtggaaattgccacgtatataaaagacctcctaagataaatgctcctgcacttaaattaccggaacaagcagcccaacccattaggggtgggattgctccgacgattgatccaacccaagtattcagaatacttattcttttcattggagtatatacggaggtatataatattaaattagctgctcctaatcctgctgttaaaccatttacaccaaaatataacatacctatacccgtagatgcagcaaccgtagcaaaacctacagcatgtaatggacttaaaatcccctgac

SEQ ID NO: 1674 - DNA, 441 bp, Ctenocephalides felis
  misc_feature (93)..(93): n = unknown
  misc_feature (436)..(436): n = unknown
  misc_feature (439)..(439): n = unknown
gattactacaggtatctagctgaagtagcaacaggagaaacccgtaacaccgtcgtagatgattcacagaaagcttatcaagatgcatttganatcagcaaggccaaaatgcagcctacacatcctattagattgggtcttgcacttaacttttccgtattttattatgaaatactaaattcacctgataaagcgtgtcaacttgcgaaacaggcattcgatgatgcgatagcagagctcgataccctaaatgaagattcatataaagattcaactctcataatgcaattgctgcgagataacttaacactgtggacatcagacacgcagggtgatggagatgagcctcaggaaggcggggacaactagtcctgaaaaccttacctatccacttccgtattccttaattcacccttatacaatcccttcgttattnggnaa

SEQ ID NO: 1675 - DNA, 173 bp, Ctenocephalides felis
  misc_feature (27)..(27): n = unknown
  misc_feature (56)..(57): n = unknown
  misc_feature (120)..(120): n = unknown
cgaaacccgagcaaaaatgtaaaaaanttaaatttagttgcgtgaattcttgcagnncacccgaaatgcagtattgtccggaaataggagcagatccggttaaggaatcctgtagcccanatcaagtgtgcgctgatcaaagtggatatctacagtgcaccactaaagaaagt

SEQ ID NO: 1676 - DNA, 325 bp, Ctenocephalides felis
  misc_feature (58)..(60): n = unknown
  misc_feature (252)..(252): n = unknown
agatctactaatgccgcgtttaccactgtcacagcaattccgcaaaccagcaaccacnnnatataaatatgatgctattgttaaatgttcaataaatgcacaaattattccacaaatcccgcatgagaccgtcacgaatacaagaattggaagctttcccacagagttaataatagcacctattatgggaaatccaatcgcatatccagcttccaacattaaagaatgcataaatgcctgttcttccattgngtctttacactcggtcgtactattcgtagcatcaatgcttagggcggacgacttcattgatactacgaatagt

SEQ ID NO: 1677 - DNA, 498 bp, Ctenocephalides felis
  misc_feature (30)..(30): n = unknown
  misc_feature (58)..(58): n = unknown
  misc_feature (244)..(244): n = unknown
agtaagaagtaacttaaaccgcaaacgttnccagcatatcaataacattattgtgttnttggcgagtgtccagcttgtgaacaaactcatcattccaaaaacatgttcgggttcagacgaataatcttttagcatttctaatgcatcatcgttcaatgttgcaccattaacttttgcaattgtgcgtaaagttttttcacatttcttcatttttccccggcttgctagccatcttggtgattcnatcatatatttgttattaattaaaaatattgcaaatggcaatgaagaaactagaacgaaatcaaaccaatttctcaaccaccacatcagaagaggcattgtgcaaattccaaatgtccacccaattccttgcaacatagcgacgtgtgagttttcatcactggtcgatatttccattcctatgacaagaacagtctggtataaagacatctgtggcagtgcagtcaccacatatccaaatacataccaataata

SEQ ID NO: 1678 - DNA, 500 bp, Ctenocephalides felis
  misc_feature (37)..(37): n = unknown
  misc_feature (39)..(39): n = unknown
  misc_feature (56)..(56): n = unknown
  misc_feature (77)..(77): n = unknown
  misc_feature (220)..(220): n = unknown
  misc_feature (474)..(474): n = unknown
gttgttgaaatattattaaatttttttattatattcngncccttttctgtatgggnttaaattacattccatgatanttttcagttttatataatctaataaattcaatttaactgttgaaatttgatcatattgtgtatatacatagcaatataaaatataaagttacacattgtctgtttcattataactgtactgcaaaattaattattttgattgnttgttactgtattattaaagttattcagattcagtcaaaatttaaatgtttggcctaaacttattattgaaatattgccaatagtgtattattacttagcaattatgtataaagattttatttattaaagcaatattcggaatgtctgtaatatcataaattatgtatataaataaatatatcaatgtgaacaataacagagaacataagctcaaattcatcatactatgtctgaaaattcaaatataaattgntctttagtgtaaataaataataaatg

SEQ ID NO: 1679 - DNA, 484 bp, Ctenocephalides felis
  misc_feature (21)..(21): n = unknown
  misc_feature (29)..(29): n = unknown
  misc_feature (58)..(58): n = unknown
  misc_feature (418)..(418): n = unknown
  misc_feature (435)..(436): n = unknown
tgaaatgtgaagacgacgtcnacgaatgntttgacccaaaatctttctcgtgcagaantgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaangtcattaactatagtannttctgattatttaaaatatataaatatagaagctttatgaaaaaaaaa

SEQ ID NO: 1680 - DNA, 113 bp, Ctenocephalides felis
  misc_feature (56)..(56): n = unknown
tttttcttctggtcattatgctgaattttaagaaccttgttaatgctgcgtgcacnggcaacgcgcctccaatgaagatattccgtagccgaagagttcttctcggtgatggt

SEQ ID NO: 1681 - DNA, 289 bp, Ctenocephalides felis
  misc_feature (52)..(52): n = unknown
  misc_feature (82)..(82): n = unknown
tttggaaaacccccaggtacagatctactaatgccgcgtttaccactgtcantttaattccgcaaaccagcaaccacaaatngaaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1682 - DNA, 498 bp, Ctenocephalides felis
  misc_feature (71)..(71): n = unknown
  misc_feature (189)..(189): n = unknown
  misc_feature (226)..(226): n = unknown
  misc_feature (371)..(371): n = unknown
  misc_feature (373)..(373): n = unknown
  misc_feature (398)..(398): n = unknown
  misc_feature (409)..(409): n = unknown
  misc_feature (438)..(439): n = unknown
  misc_feature (450)..(450): n = unknown
  misc_feature (452)..(452): n = unknown
cgtcaagtccaatccaagagtggaatttttttcaggaaagctactagagaggtgggatttccaccagtggnatcgagaaataatcgcacaattagctgtgttcgtgccctggaccaatatgtaaatggccaaggaggctatgccactcttgtcaatggtggagttggctggaaaaatgtaactttactnctatcttctcagactggcaaaggatttaacttcttanttgaaatttggggatattagattagaaatataatgaaaatggtgaatatagaaaaaaaattaaatatacaatagtattttaaatttggcacacatctatctatgcatccataaataaaggttatatacagcattcatttataatngnttaagaattataatgattttatgangtttagtatantgttcaccaatgtaaccaccaatggcagnnttataaatctngngatatatatatgaggtaaattatattccgaaaaatggatgaaccct

SEQ ID NO: 1683 - DNA, 500 bp, Ctenocephalides felis
  misc_feature (28)..(28): n = unknown
  misc_feature (31)..(31): n = unknown
  misc_feature (58)..(58): n = unknown
  misc_feature (60)..(60): n = unknown
  misc_feature (113)..(113): n = unknown
  misc_feature (137)..(137): n = unknown
  misc_feature (139)..(139): n = unknown
  misc_feature (152)..(152): n = unknown
  misc_feature (165)..(165): n = unknown
  misc_feature (186)..(186): n = unknown
  misc_feature (261)..(261): n = unknown
  misc_feature (374)..(374): n = unknown
  misc_feature (376)..(376): n = unknown
  misc_feature (418)..(418): n = unknown
  misc_feature (472)..(472): n = unknown
  misc_feature (500)..(500): n = unknown
ttttaacggcccaaacgatttatttttnttnaaaagatacatgtaatttcataaagcngntatatttatatattttaaataatcagaaattactatagttaatgacattttgnttgtgctccttacataaaatacantnttatacattttantttttatacatantttttatatttaattgcacanatcatttgtgtatttattatattaattgactactttatgataatttgaatcctaattagtctattcaagattgcnttcctgggttaagccttacttagcaatctcacttttgcattcttcgccgggtggcgtgggtatgcatcgcaactccgttttatcaaagtgcaagccatttggacaatcataangntttatttgccatttgctgttaaccaagaaacattgataatantctttcaatctcttccgatccgggaaaaaaacgcttttcactttttgcatgcanttctgcaccgaagaaaagaattttgggn

SEQ ID NO: 1684 - DNA, 229 bp, Ctenocephalides felis
  misc_feature (62)..(62): n = unknown
  misc_feature (122)..(122): n = unknown
tattctgaactaaacattgttaattcaaatctttattctaaattaaatctttcatggaatcntgcttgaaaattgaaaattactctccattattttacatgcgataatttattttgttgtanatcaaagatataagaattagtgataaatttaaagaaataagagaacaataaacatattgttaaatcatcatttttatagtaaatgatagatttatgacaacgtctgt

SEQ ID NO: 1685 - DNA, 498 bp, Ctenocephalides felis
  misc_feature (40)..(40): n = unknown
  misc_feature (60)..(61): n = unknown
  misc_feature (118)..(118): n = unknown
  misc_feature (356)..(356): n = unknown
  misc_feature (358)..(358): n = unknown
  misc_feature (374)..(374): n = unknown
tctgcatgatgtctaataatattctcgatttttgcgcagnttgtttgttgtattttagannctaagttgaagaagaacttttacaaataattcactagaatattcatttattcataantttagattctggagtaaacaatatggaagcaaaggtttcatttcaaacagcttgttttaaattgtaattgaataaaattaatacaaaataatacatatatacaatgtgtagcactactgcccttggacaggtccgtccaacttgacaccatccacataggtcccgcgcgttagcgacctcggtcactacaaccttatattaagaaagcccacctagtgtgaaattttcagaaaatcgnanttttgacttttccgtntttcgataagttaaacctttaaaaataatcacagtgctgatcaagctttccgacaaacgcaagaacatatcaataaactcaaatgtggcttgccaaaatggaagatttgcattaaatggaaacc

SEQ ID NO: 1686 - DNA, 345 bp, Ctenocephalides felis
  misc_feature (30)..(30): n = unknown
  misc_feature (58)..(58): n = unknown
  misc_feature (154)..(154): n = unknown
  misc_feature (220)..(220): n = unknown
  misc_feature (335)..(335): n = unknown
ttttggagtatctgttcaaggtatcatttntctaccgtgcagcatactttggattctntgacaccgctcgtggaatgttgccagaccccaagaacaccccattagttatcagctgggccattgcacaagccgtcacaactgttgctggtattgngtcatatccattcgacactgtccgtaggcgtatgatgatgcagtctggacgtgcaaagtctgaaangttgtacaagggaacactgcactgctgggccaccattgccaagacagaaggaagtggtgccttcttcaagggagctttctccaatatcctccgtggtactggtggagctttcgtnttggtcttgt

SEQ ID NO: 1687 - DNA, 396 bp, Ctenocephalides felis
  misc_feature (8)..(8): n = unknown
  misc_feature (55)..(55): n = unknown
  misc_feature (81)..(81): n = unknown
  misc_feature (157)..(157): n = unknown
  misc_feature (178)..(178): n = unknown
  misc_feature (180)..(180): n = unknown
  misc_feature (206)..(206): n = unknown
  misc_feature (281)..(282): n = unknown
  misc_feature (301)..(301): n = unknown
  misc_feature (307)..(307): n = unknown
  misc_feature (310)..(310): n = unknown
  misc_feature (355)..(355): n = unknown
aaggagcnttatatgcaaattatatttttgagcctttataaatctgtgaatgaanggcaccactctatcttctaacctaangcgtactttccgctttacagaacttctttaataggtaatacttttaattgcagccgtatcatattatagcttgtangtgttatattttatttgtaantngttgttcatatttctcaaacgattgntcatgtattacacagtattaaaataaaccttggatgcaataattgttataacaacattgtcgttagtaataaaannttatcagtggattataatngtaatntgntttatccttgtatgtttattgttgcattgatataaacagtagcanattataacaataaaatcaacttcccaattcttgggaatata

SEQ ID NO: 1688 - DNA, 474 bp, Ctenocephalides felis
  misc_feature (56)..(56): n = unknown
  misc_feature (391)..(391): n = unknown
tgaaatgtgaagacgacgtcaacgattggtttgacccaaaatctttctcgtacagngctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaacgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgnttttatgtaaggagcacaaacaaaatgtcattaactatagtacttctgattatttaaaatatataaatatagaagctttatga

SEQ ID NO: 1689 - DNA, 386 bp, Ctenocephalides felis
  misc_feature (88)..(88): n = unknown
  misc_feature (101)..(101): n = unknown
  misc_feature (159)..(159): n = unknown
  misc_feature (189)..(189): n = unknown
  misc_feature (259)..(259): n = unknown
cctacacaactcagggcaatggcagtatgtatttctttaatgatgggtcgattaggaagtggtgttggaagcaatgttgtaggaatanttctagattatanttgcgatttaacatttttaatatcaggaacatctctgatagcatgtggagtgattgcnttctttataccgaacatttatcagaagcangtggatagaagaacgagcattgcttcatatggaccataaccatatttccgtcgtgtgttgtgaaatgcanttatactttgagaaagtattatcaattacaaagaaaattcagaagttgctactgaatcattttctaaaacatcgacatgaaaattaataactctttattgttattagattcgatgtaagatatatgt

SEQ ID NO: 1690 - DNA, 330 bp, Ctenocephalides felis
  misc_feature (27)..(27): n = unknown
  misc_feature (75)..(75): n = unknown
  misc_feature (114)..(114): n = unknown
  misc_feature (282)..(282): n = unknown
  misc_feature (304)..(304): n = unknown
  misc_feature (316)..(316): n = unknown
  misc_feature (330)..(330): n = unknown
cactatacgtgcgaaaactgagaatanttctcccgctaaaaatactgttctactggggactttaacacaagcagncattcctgccaaaaacatccttgatgacaaatctgcagntgctgcggtagacacacaaattgctgtatcagtctttgaccagcctaatgcaaacagatacattgtttgaatagcagaaaatgctatgtcggagtatagtgcaaatgtcactccaataaccatatttacataaatccagtcttttaacaaagttaaatccaaaaagtnaacgataacttgcaattttctnctagatttcttntctaccggtgcagn

SEQ ID NO: 1691 - DNA, 498 bp, Ctenocephalides felis
  misc_feature (42)..(43): n = unknown
  misc_feature (130)..(130): n = unknown
  misc_feature (271)..(271): n = unknown
  misc_feature (390)..(390): n = unknown
  misc_feature (466)..(466): n = unknown
atatatcttacatcgaatctaataacattaaagagttattanntttcatgtcgatggtttagaaaatgattcagtagcaacttctgaattttctttgtaatcgataatactttctcaaagtataattgcntttcacaacacacgacggaaatatggttatggtccatatgaagcaatgctcgttcttctatccacttgcttctgataaatgttcggtataaagaatgcaatcactccacatgctatcagagatgttcctgatattaaaaangttaaatcgcaattataatctagaattattcctacaacattgcttccaacaacacttcctaatcgacccatcattaaagatatacatactgccattgccctgagttgtgtagggtacanatctactaatgccgcgtttaccactgtcacagcaattcgcaaaccagcaaccacaaatataaatatgagctattgntaaatggtcaataaaagcacaaattattccac

SEQ ID NO: 1692 - DNA, 362 bp, Ctenocephalides felis
  misc_feature (55)..(56): n = unknown
  misc_feature (90)..(90): n = unknown
  misc_feature (325)..(325): n = unknown
gaggagactttgtttaccgtaatggtttaccatttgaaattccaaaaggaaattnnctattgaatgattaaatgtaatagattaatcaanttttagatgattaaaattgttctattactacaatagcaacctctgcctgaaaattaaccgaacaaacttctaacatccttattaatgtatagattttgaataataacatagaaatcatactatttttttgatgactctaataaaaaaatgtataaatagccatgcctgatatatttttgatgaccttaataaaaaaatgtttaaatggccatgtctgaaaagatttctatgtgtntttttttgttaacattttattgttgaatggataaaag

SEQ ID NO: 1693 - DNA, 132 bp, Ctenocephalides felis
  misc_feature (28)..(29): n = unknown
cttttgcatgtaggatccaatggatctnngaaatagtccaactcttggacaaatgaatggttgctgccaaatacgaacgctgctggaatttgtttcaactggaattagttcttgagactccaaagacaatgt

SEQ ID NO: 1694 - DNA, 386 bp, Ctenocephalides felis
  misc_feature (42)..(42): n = unknown
  misc_feature (58)..(58): n = unknown
  misc_feature (88)..(88): n = unknown
  misc_feature (100)..(100): n = unknown
atatatcttacatcgaatctaataacatttaagagttattanttttcatgtcgatgtnttagaaaatgattcagtagcaacttctganttttctttgtanttgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1695 - DNA, 424 bp, Ctenocephalides felis
  misc_feature (27)..(27): n = unknown
  misc_feature (210)..(210): n = unknown
  misc_feature (219)..(219): n = unknown
  misc_feature (345)..(345): n = unknown
  misc_feature (348)..(348): n = unknown
gatcggttgcaatttgtcattgcaccnagcataaattgatgggtccggtgcataggctataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcngtctttcgnatctggctgatatcctacaaccgcgcatgtagtttctgccgtcttacagttttccccaggttttgatgagcacatgtcatctacacaaaatggagcatcggaatttgagtttctgcaattgattgntgnaattggggtctcttgtccagcgcacaacttcaaagtagaacaatcgtgacaaaatgttcccaactgcttattaagt

SEQ ID NO: 1696 - DNA, 392 bp, Ctenocephalides felis
  misc_feature (29)..(29): n = unknown
  misc_feature (43)..(43): n = unknown
  misc_feature (56)..(56): n = unknown
  misc_feature (81)..(81): n = unknown
  misc_feature (115)..(115): n = unknown
  misc_feature (122)..(122): n = unknown
  misc_feature (131)..(131): n = unknown
  misc_feature (184)..(184): n = unknown
  misc_feature (193)..(193): n = unknown
  misc_feature (211)..(211): n = unknown
  misc_feature (280)..(280): n = unknown
  misc_feature (285)..(285): n = unknown
  misc_feature (288)..(288): n = unknown
  misc_feature (294)..(294): n = unknown
  misc_feature (305)..(305): n = unknown
  misc_feature (368)..(368): n = unknown
  misc_feature (374)..(374): n = unknown
  misc_feature (392)..(392): n = unknown
acatatcttacatcgaatctaataacttntaaagagttattanttttcatgtcganggtttagaaaatgattcagtagcancttctgacttttctttgtaattgataatactttntcaaagnataattgcntttcacaacacacgacggaaatatggttatggtccatatgaagcaatgctcgntcttctatncacttgcttctgataaangttcggtataaagaatgcaatcacttcacatgctatcagagatgttcctgatattaaaaatgttaaatncgcanttntaatcnaagaattattnctacaacattgctttcaacaaacactttctaatcgacccaatcattaaagatatacatactgnccttgncctgagttgtgtaggggn

SEQ ID NO: 1697 - DNA, 173 bp, Ctenocephalides felis
  misc_feature (26)..(26): n = unknown
  misc_feature (29)..(29): n = unknown
  misc_feature (56)..(57): n = unknown
  misc_feature (93)..(93): n = unknown
  misc_feature (115)..(115): n = unknown
cgaaacccgagcaaaaatgtaaaaanttnaaatttacttgcgtgaattcttgcagnncacccgaaatgcagtattgtccggaaataggagcanatccggttaaggaatcctgtancccacatcaagtgtgcgctgatcaaagtggatatctacagtgcaccactaaagaaagt

SEQ ID NO: 1698 - DNA, 387 bp, Ctenocephalides felis
  misc_feature (27)..(27): n = unknown
  misc_feature (130)..(130): n = unknown
atatatcttacatcgaatctaataacnataaagagttattaattttcatgtcgatgttttagaaaatgattcagtaacaacttctgaattttctttgtaattgataatactttctcaaagtataattgcntttcacaacacacgacggaaatatggttatggtccatatgaagcaatgctcgttcttctatccacttgcttctgataaatgttcggtataaagaatgcaatcactccacatgctatcaagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1699 - DNA, 280 bp, Ctenocephalides felis
  misc_feature (16)..(16): n = unknown
  misc_feature (112)..(112): n = unknown
  misc_feature (120)..(120): n = unknown
  misc_feature (224)..(224): n = unknown
  misc_feature (264)..(264): n = unknown
ggccaaatgcatgcangagggttgcattaaatatacaactagcagcagccagagtttcaactgatgttggcattaaagtaggagaagccctcaggaatgtcgtggaacttcntttaaatntgggaaaatgttcttcagacaatttgaataaatgggaatccagattggaagaaattaatgatgttgtggaaaattgcatcgtgtgaaattgtaacttgaaatantttttcttaactattagttttatagatgaacaaatacatnatctaataaaccagca

SEQ ID NO: 1700 - DNA, 275 bp, Ctenocephalides felis
  misc_feature (45)..(45): n = unknown
  misc_feature (54)..(54): n = unknown
  misc_feature (59)..(59): n = unknown
  misc_feature (81)..(81): n = unknown
  misc_feature (100)..(100): n = unknown
  misc_feature (121)..(121): n = unknown
  misc_feature (156)..(156): n = unknown
  misc_feature (201)..(201): n = unknown
  misc_feature (226)..(226): n = unknown
  misc_feature (251)..(251): n = unknown
  misc_feature (266)..(266): n = unknown
tttaagcctaaaagaaatccaagctttttcatctcaaagtatcantcttgattntaggngtgatgtaattattttatatanttatatataaagaaactgntttacaatcagtgaatatttncacaaaattattaaaactatataaatataatacangtccatcataggtatgactactttcgacgaaatattcataatttngaccaactaccctctttcataattntgaccatattatcaagttaacccanacttatcttaaatangcgatatga

SEQ ID NO: 1701 - DNA, 435 bp, Ctenocephalides felis
  misc_feature (26)..(26): n = unknown
  misc_feature (246)..(246): n = unknown
  misc_feature (404)..(404): n = unknown
ttggtatatgcatcgttaaagcattntttctttattattttaaaatgaaattaaatgtcaaactctaaaattactcactgcaaatcaattctaatgcaggtttgtcaaaatgtaaacaaactaaaaatcacatctttacgttttatgatttaacaatacataaccaaagaggttgcacagcaataagcattgtttcatacttcacacataaataaattaaataaaaaagaaaaccaatcctgcagnttttatgcattagaaaatatgcgtgcaacctattttccttatcatttttaaagggggatgtctataaaaatgttattttagcaaacagttatagatattgtattcgctaaaggtatctttgagattcccgagacatgttccactgctcaagcagtgcntttctgtaacggtgttcttgaacgggttgcc

SEQ ID NO: 1702 - DNA, 425 bp, Ctenocephalides felis
  misc_feature (52)..(52): n = unknown
  misc_feature (83)..(83): n = unknown
  misc_feature (87)..(87): n = unknown
  misc_feature (219)..(219): n = unknown
cttgcttgtggaggcagcagtggatttttttcaatataaccaaaaacaatanttacaggcttttgtcaaaaacaagatcatanctgnttatataatataagaagttcttataataaaagtgcagtattatttttacatcaatttaaacatcactaaaatcaaaacctaacctcaaaatttcactaagtgaaaatgttgaagactttatttaatcaaagngtacgacaaaacagcactaatgcctccttagtaagtacagtttttcacaatagaaaccctagaaatttagaacgaatgaggattgcttataaacctgatggatggcaagtagataaacctggacgctcattctggcacaaattagagttaactgaaagctctcgatatataactgcacgagtggtgcattggaaggaaggccctgt

SEQ ID NO: 1703 - DNA, 465 bp, Ctenocephalides felis
  misc_feature (58)..(58): n = unknown
  misc_feature (75)..(75): n = unknown
  misc_feature (289)..(289): n = unknown
  misc_feature (363)..(363): n = unknown
tcgatgaaatcaagaaattgttgtaaatttagcaataaacaaccataacaaaaaaagngaaaaatctaaaaacantttaaattagcaaaaccaagtgtatttgaatttcatttttgcacaagttacctttttgtattaaaatatatgtatatttatgaatatgtatttcttgtattttaggttaaattcgttatagaataatttggaaatacatattcataatgctaaagtattaaattggcttttttccattaaaatcctatttaacattatacatatattttattgncaaatgtgaggcggtatggaatcacgggtggctgctttctgagtagtcgaaccttttaggcaaaaattgtgtanatcaaaactcaagttctacaatcttgagctcatccacattctcagaacatccatgtatttaaggtaacttattgtatttaacagcttttgagggaaatactg

SEQ ID NO: 1704 - DNA, 342 bp, Ctenocephalides felis
  misc_feature (19)..(19): n = unknown
  misc_feature (35)..(35): n = unknown
  misc_feature (59)..(59): n = unknown
  misc_feature (131)..(131): n = unknown
  misc_feature (221)..(221): n = unknown
  misc_feature (259)..(259): n = unknown
  misc_feature (307)..(307): n = unknown
  misc_feature (318)..(318): n = unknown
ttaaaacaaagaaaattanttcaaatttttttcanttcttagcttgcgtgtgcatgggnttgattatttagaaatctttataaacaataggacacttacatttcaaaaataggtgttacgaataaattatnatctctttcactacatatattacaatcaacatttattaaataagtgttgaatttatttattgtgcaaataataatatgctttccatgttngtaatcaatttattaatttaattgtattaatttgtcgnttttacctacacattttagctactggtaagctaggcataatgtgaaangtatatcttanttcttttgacatcaaaagctttca

SEQ ID NO: 1705 - DNA, 408 bp, Ctenocephalides felis
  misc_feature (17)..(17): n = unknown
  misc_feature (94)..(94): n = unknown
  misc_feature (100)..(100): n = unknown
  misc_feature (118)..(118): n = unknown
  misc_feature (140)..(140): n = unknown
  misc_feature (191)..(191): n = unknown
  misc_feature (214)..(214): n = unknown
  misc_feature (283)..(283): n = unknown
  misc_feature (321)..(321): n = unknown
  misc_feature (338)..(338): n = unknown
  misc_feature (342)..(342): n = unknown
  misc_feature (355)..(355): n = unknown
  misc_feature (373)..(373): n = unknown
cttctatatttatatantttaaataatcattttattactatagttaatgacattttgttggggctccttacataaaatacacttttatacattntaattnttatacatattttttatntttaattgcacacatcattcgngtatttattatattaattgactactttatgataattagaatcctaattagnctattcaagattgttttcctggnttaagccttacttagcaatctcacttttgcattcttcgccgggtggcgtgggtatgcatcgcaacttcngttttatcaaagtacaagccattttggacaatcattangttttattttgccattnggtngttaaacccaaanaaaccatttgataatatnttttttacaaattctctttccatccggaaaaaaac

SEQ ID NO: 1706 - DNA, 461 bp, Ctenocephalides felis
  misc_feature (29)..(29): n = unknown
  misc_feature (59)..(59): n = unknown
  misc_feature (80)..(81): n = unknown
  misc_feature (83)..(83): n = unknown
  misc_feature (310)..(310): n = unknown
  misc_feature (315)..(315): n = unknown
  misc_feature (331)..(331): n = unknown
  misc_feature (366)..(366): n = unknown
  misc_feature (382)..(382): n = unknown
  misc_feature (439)..(439): n = unknown
tgaaatgtgaagacgacgtcaacgaattntttgacccaaaatctttctcgtgcagaggntgcatgcaaaagtgaaaacgnntnttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaatttaggattcaaattatcataaagtngtcanttaattttaataaatncacaaatgatctgtgcaattaaatataaaaaatangtataaaaaataaaanggataaaattgctttttatgtaaggagcacaaacaaaatgtcattaactatagtaanttctgattgttttaaaatatat

SEQ ID NO: 1707 - DNA, 363 bp, Ctenocephalides felis
  misc_feature (61)..(62): n = unknown
  misc_feature (71)..(71): n = unknown
cgtcaagtccaatccaagagtggaaactttttttggaaagctactagagaagtgtcatttnnaccagtggnatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaattaaatatacaatagtattttaaatttggtacacatctatctatgcatccataaataaaggttatatacagcattcaaaa

SEQ ID NO: 1708 - DNA, 232 bp, Ctenocephalides felis
  misc_feature (24)..(24): n = unknown
ttccgcaaaccagcaaccacaaangtaaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1709 - DNA, 496 bp, Ctenocephalides felis
  misc_feature (30)..(30): n = unknown
  misc_feature (33)..(33): n = unknown
  misc_feature (125)..(125): n = unknown
  misc_feature (317)..(317): n = unknown
  misc_feature (338)..(338): n = unknown
aaaatggcaactgctgtttgttgcataggnttnggcattttcatggcaggtttagcattgtctggtaatgatcacatcgcggctattgtgttcatgactctggcgactgcagttaatggagccgnttcaactgggccattagccagctttgtggatttgagtcccaattatgccagtattacgctgggattgagtggtatgatttctgtaatgcctggttttatttcgcctgctatcgttggtatactaacatttgaaaaccaaacgatagagcaatggcagaaagttttcctcctagcgacagcaatgttggtcgnttgtggacttttatatttggngtttgcggattccaatctacaatcctggaacagtccagataaaattgtccaagaccccgaagaaattgttccaatgacagaaaaacctcgtattgttatcactaaaaattcaattccaacaagtgatctggcttatactagggcgccaaagaaaaaaa

SEQ ID NO: 1710 - DNA, 498 bp, Ctenocephalides felis
  misc_feature (56)..(56): n = unknown
  misc_feature (393)..(393): n = unknown
  misc_feature (482)..(482): n = unknown
  misc_feature (490)..(491): n = unknown
  misc_feature (494)..(494): n = unknown
tgaaatgtgaagacgacgtcaacgattggtttgacccaaaatctttctcgtgcagngctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaaagtagtcaattaatataataaatacacaaatgatctgtgcaattaaatataaaaaatatgtataaaaattaaaatgtataaaattgtnttttatgtaaggagcacaaacaaaatgtcattaactatagtactttctgattatttaaaatatataaatatagaagctttatgaaccanattttatnnatnattt

SEQ ID NO: 1711 - DNA, 500 bp, Ctenocephalides felis
  misc_feature (30)..(30): n = unknown
  misc_feature (59)..(59): n = unknown
  misc_feature (66)..(66): n = unknown
  misc_feature (119)..(119): n = unknown
  misc_feature (205)..(205): n = unknown
  misc_feature (238)..(238): n = unknown
  misc_feature (256)..(256): n = unknown
  misc_feature (353)..(353): n = unknown
  misc_feature (391)..(391): n = unknown
  misc_feature (397)..(397): n = unknown
  misc_feature (499)..(499): n = unknown
aaataattcaggagccccgcaaagtcaganttctatatgactttgaagcagcagaaganggacganttgaccttcttagctggtgaaataatccatatgctagatgattcacatcctanttggtggaaaggatataatcaacatggagaaggtttatttcctgcaaactttgtaactgctgatttatcaagttgaaccagaacantttagaattgatgctaacaagaaatctgttcanttttctgatgctgttcangtcaaaactatatctcatgatgatgaaaccagtcctgaaattaatgaagaaagtatagatactttattaaatttattacatgaagcaaatcctgaanatcctaatgatgatacagagcaaatgctcaacttagangttcangtaaataaaatgggccctctgattgatgctgaattaagaaaatattgacaggaaacatgctcaacttacgcaattgagtggcgatttagtagaagcacttant

SEQ ID NO: 1712 - DNA, 498 bp, Ctenocephalides felis
  misc_feature (34)..(34): n = unknown
  misc_feature (63)..(63): n = unknown
  misc_feature (366)..(366): n = unknown
  misc_feature (457)..(457): n = unknown
aataaatcatggtctgaagagacaaataagattnaaagtcaaataataccttgtcagcatggntatgaatatgacagaacatggtatttatcaacggctccgtcagatcaagactgggtttgtgatagagaactctatgtaactaatacatttgctattggacgtgcaggcgaagtcataggcacatttatttttggacaattaggagataggattggaagaagaccagtattttacttaagtctcatcacaatcgtcaccggaagactaattacagcatttacttccagttggtttattgtttttataacagcggcttttcttggttcactaacatctacatctgtttttcaaagccctttgatnattgcgatggaaatatccagaagtgaagatagagcacacattgccatgatgcagtccatcgggtggaccagtggaatgattcttatgccgntactgatgtgggcgacgcgagattggtttatctttgctttg

SEQ ID NO: 1713 - DNA, 386 bp, Ctenocephalides felis
  misc_feature (32)..(32): n = unknown
  misc_feature (34)..(34): n = unknown
  misc_feature (42)..(42): n = unknown
  misc_feature (100)..(100): n = unknown
  misc_feature (130)..(130): n = unknown
  misc_feature (217)..(217): n = unknown
  misc_feature (283)..(283): n = unknown
atatatcttacatcgaatctaataacaataantngttattanttttcatgtcgatgttttagaaaatgattcagtagcaacttctgaattttctttgtanttgataatactttctcaaagtataattgcntttcacaacacacgacggaaatatggttatggtccatatgaagcaatgctcgttcttctatccacttgcttctgataaatgttcggnataaagaatgcaatcactccacatgctatcagagatgttcctgatattaaaaatgttaaatcgcanttataatctagaattattcctacaacattgcttccaacaacacttcctaatcgacccatcattaaagatatacatactgccattgccctgagttgtgtagggt

SEQ ID NO: 1714 - DNA, 432 bp, Ctenocephalides felis
  misc_feature (28)..(28): n = unknown
  misc_feature (55)..(55): n = unknown
  misc_feature (57)..(57): n = unknown
  misc_feature (59)..(59): n = unknown
  misc_feature (100)..(100): n = unknown
atatatcttacatcgaatctaataacanttaagagttattaattttcatgtcgangngntagaaaatgattcagtagcaacttctgaattttctttgtanttgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggtacgaaaggaccattaatttataataattattttaatttgaattacc

SEQ ID NO: 1715 - DNA, 117 bp, Ctenocephalides felis
  misc_feature (33)..(33): n = unknown
ctgtatttttcttctggtcattatgctgaattncaagaaccttgttaatgctgcgtgcaccaacaacgcgcctccaatgaagatattccgtagccgaagagttcttctcagtgatgg

SEQ ID NO: 1716 - DNA, 235 bp, Ctenocephalides felis
  misc_feature (28)..(28): n = unknown
  misc_feature (30)..(30): n = unknown
aagcaagttttcttgggtggagttgacntnaagacccaattctggcgttacttcgcaggaaacttggcatctggtggtgctgctggagccacatcattgtgcttcgtctacccacttgatttcgcccgtaccagattggccgctgatgtaggtaaaggcgctggtcaacgtgaattctctggattgggcaactgcttgaccaaaatcttcaagtctgatggtctccctggattgt

SEQ ID NO: 1717 - DNA, 498 bp, Ctenocephalides felis
  misc_feature (26)..(26): n = unknown
  misc_feature (56)..(57): n = unknown
  misc_feature (67)..(67): n = unknown
  misc_feature (76)..(76): n = unknown
  misc_feature (78)..(78): n = unknown
  misc_feature (120)..(120): n = unknown
  misc_feature (257)..(257): n = unknown
gggtatctggcgtcatatgtggttcntttagtatacaatgtatgggcctaatactnntaatgcattngaaactatngntccaatggaaattcctgtctgcctcaaacaggttggatatgnttccattgcttgcagattcacaacataaaacgtgatgcttatgcaaaatttcattaccacggctaacagtgataccaaattctggagggattcatcattggcaatgcatataagaatggaagatgctgccagagcanttccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgta

SEQ ID NO: 1718 - DNA, 131 bp, Ctenocephalides felis
  misc_feature (5)..(5): n = unknown
  misc_feature (33)..(33): n = unknown
  misc_feature (55)..(55): n = unknown
  misc_feature (58)..(58): n = unknown
  misc_feature (113)..(113): n = unknown
attgnctttggagtctcaagaactatttccagntgaaacaaattccagcagcgtnggnatttggcagcaaccattcatttgtccaagagttggactatttcgcggtccattgnatcctacatgcaaaaggt

SEQ ID NO: 1719 - DNA, 428 bp, Ctenocephalides felis
  misc_feature (3)..(3): n = unknown
  misc_feature (57)..(57): n = unknown
  misc_feature (319)..(319): n = unknown
aanttgttgatggcacaactttttgtttaaagttttgtaaactgattaacaaaaggnggaaacattaccgataagtagaaaataatataactaacagtttgtaatatgctataaatcttaaaacaacactcttgtaacaaaatattatagggagatattgaagtgaaactttaaaggtaaatagaaaagaaagcatttggttgaaaatgatgaaatttgtttcaaaacttctgaacttttctagaaacgttgcaaactgtctgaatttattgtaaattatcaatgtaacttttgcagttttatttacgaagtttcactnctcccgcactattttttttttttgcaaataaatttaagattttatgatttttttgtgaacaacgtgcagtatttttgtatggatataaaataataaatctacaacatgt

SEQ ID NO: 1720 - DNA, 205 bp, Ctenocephalides felis
  misc_feature (3)..(3): n = unknown
  misc_feature (26)..(26): n = unknown
canttaatgatctacaacttgttcantttagccttaactgatggatcgaacgcgtggggaagttcaatcgaatccttcctaaatgttattgaaactgaagaagcacctccaacctttaatagaactaacaaattcactcaaggtttccaaaacttgatagatgcctacggagttgctagttacagagaagtaaatccagctctgt

SEQ ID NO: 1721 - DNA, 137 bp, Ctenocephalides felis
  misc_feature (65)..(65): n = unknown
tttttttttgattagaacaaatatattcatggatttaaaaaaatctaaattgtaaaattcttaantgccttatcatatttgcgagcctgtgttcaaccataatatttttttatataacacataaagtaaaacaaagt

SEQ ID NO: 1722 - DNA, 424 bp, Ctenocephalides felis
  misc_feature (28)..(28): n = unknown
  misc_feature (54)..(54): n = unknown
  misc_feature (84)..(84): n = unknown
  misc_feature (157)..(157): n = unknown
  misc_feature (183)..(183): n = unknown
  misc_feature (186)..(186): n = unknown
  misc_feature (200)..(200): n = unknown
  misc_feature (214)..(214): n = unknown
  misc_feature (257)..(257): n = unknown
  misc_feature (315)..(315): n = unknown
  misc_feature (354)..(354): n = unknown
taataagcagttgggaacattttgtttngattgttctactttgaagttgtgcgngggacaagaaaccccaattacaacaatcanttgcagagactcaaattccgatgctccattttgtgtagatgatatgtgctcatcaaaacctggggaaaactgnaagacggcagaaactacatgcgcggntgnaggatatcagtcanatccgaaagactgnacaagatacttattctgcaaagatggtaaaggtcaggttttcnaatgcccacctaactatgtatatgatcattctaaaaatatgtgtaaaaagaaatcgtnagaagctgattgcaccgtcatgaaatgcacaaatcccanttcttttataacctatgcaccggacccatcaatttatgcttggtgcaatgacaaattgcaacccgatcgt

SEQ ID NO: 1723 - DNA, 402 bp, Ctenocephalides felis
  misc_feature (37)..(37): n = unknown
  misc_feature (45)..(45): n = unknown
  misc_feature (80)..(80): n = unknown
  misc_feature (84)..(84): n = unknown
  misc_feature (111)..(111): n = unknown
  misc_feature (124)..(124): n = unknown
  misc_feature (160)..(160): n = unknown
  misc_feature (169)..(169): n = unknown
  misc_feature (172)..(172): n = unknown
  misc_feature (203)..(203): n = unknown
  misc_feature (234)..(234): n = unknown
  misc_feature (348)..(348): n = unknown
  misc_feature (367)..(367): n = unknown
tttttttttttttttttttcttcataaagcttttatntttatatnttttaaataatcagaagttactatagttaatgacntttncgtttgtgctccttacataaaatacanttttatacatttnaatttttatacatattttttatatttaattgcacanatcatttgngtntttattatattaattgactactttatgatantttgaatcctaattagtctattcaagattgntttcctggtttaagccttacttagcaatctcacttttgcattcttcgccgggtggcgtgggtatgcatcgcaactccgttttatcaaagtgcaagccatttggacaatcataangttttatttgccatttgtngttaaccaagaaacattgataatattttttacaat

SEQ ID NO: 1724 - DNA, 411 bp, Ctenocephalides felis
  misc_feature (26)..(26): n = unknown
  misc_feature (57)..(57): n = unknown
  misc_feature (60)..(60): n = unknown
  misc_feature (77)..(77): n = unknown
  misc_feature (82)..(82): n = unknown
  misc_feature (127)..(127): n = unknown
  misc_feature (129)..(129): n = unknown
  misc_feature (135)..(135): n = unknown
  misc_feature (184)..(184): n = unknown
  misc_feature (204)..(204): n = unknown
  misc_feature (211)..(211): n = unknown
  misc_feature (213)..(213): n = unknown
  misc_feature (394)..(394): n = unknown
tttttttttttttttttttttgaacnttccaaacgatttatttttattaaaaagggncangtaatttcataaagctnctatntttatatattttaaataatcagaaattactatagttaatgacatntngtttgngctccttacataaaatacaattttatacattttaatttttatacatatnttttatatttaattgcacanatcattngngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagcccatttgggacaatcataangttttattttgcccttg

SEQ ID NO: 1725 - DNA, 407 bp, Ctenocephalides felis
  misc_feature (25)..(25): n = unknown
  misc_feature (48)..(48): n = unknown
  misc_feature (73)..(73): n = unknown
  misc_feature (84)..(84): n = unknown
  misc_feature (102)..(102): n = unknown
  misc_feature (117)..(117): n = unknown
  misc_feature (121)..(121): n = unknown
  misc_feature (130)..(130): n = unknown
  misc_feature (187)..(187): n = unknown
  misc_feature (198)..(198): n = unknown
  misc_feature (263)..(263): n = unknown
  misc_feature (267)..(267): n = unknown
  misc_feature (288)..(288): n = unknown
  misc_feature (359)..(359): n = unknown
ttatatatcttaaataatcagaaantactatagttaatgacattttgnttgtgctccttacataaaatacaantttatacattntaatttttatacatatcntttatatttaattgnacanatcattcgngtatttattatattaattgactactttatgataatttgaatcctaattagtctattnaagattgtttncctggtttaagccttacttagcaatctcacttttgcattcttcgccgggtggcgggggtatggancagncaccccccgctttatcaaagngcaagccatttggacaatcataacgttttatttgccatttgttggtaacccaagaaacattgataatattntttacaaatctcttccatcgggaaaaaaccttttcccttttgcatgcc

SEQ ID NO: 1726 - DNA, 448 bp, Ctenocephalides felis
  misc_feature (29)..(29): n = unknown
  misc_feature (57)..(57): n = unknown
  misc_feature (149)..(149): n = unknown
  misc_feature (414)..(414): n = unknown
  misc_feature (421)..(421): n = unknown
  misc_feature (431)..(431): n = unknown
aattggaatatcacaacaccatcagctangtctgaatacaaccaattaacatgtggngaaacgcccatagaattcatccaattccggtaagttttttcttcgcgggtctcttccacagtctctaatccctctatttcgccttctggacnatctaatcctggatggttgttgaacaagttggctacgaacgctaaattcaacttataaacgccattaacaacatctgctgctgttacaaagcttctgcatttgagtttagcagcttgttgcagcatgatctcagctctctttgtcatatcttgttccatgagagcttcgttcgtaacttgagcttctggaggtgcaatttgtttcaacagaatagtataaacctctgaatccgaaatgtcgacttggaagttattggaacgtctnatagttncagcggttgnaagatgatgatttaccc

SEQ ID NO: 1727 - DNA, 485 bp, Ctenocephalides felis
  misc_feature (28)..(28): n = unknown
  misc_feature (413)..(413): n = unknown
  misc_feature (457)..(457): n = unknown
tgaaatgtgaagacgacgtcaacgaatngtttgacccaaaatctttctcgtgcagagctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgcttttatgtaaggagcacaaacnaaatgtcattaactatagtaatttctgattatttaaaatatatnaatattgaagctttttgaaatttaaaaa

SEQ ID NO: 1728 - DNA, 305 bp, Ctenocephalides felis
ggcattcgacgttctgcattcttaacgatacctattatctgttttcaaatcttgggttctccttgtaattagtgattgaatgattttagccttcttgtcagtccggatgtatgggttagtcgtgtgctgttattaatttagtgaaatgtattcgaacaaatggcttaacttcatagcgctatactcacctctctgttatctttctgactctttatatatacatggtatgtatatatgtatgtatatatatatatatatacatatgcatatatctgtttcactagtcaacaccttaaatgtgatgt

SEQ ID NO: 1729 - DNA, 498 bp, Ctenocephalides felis
  misc_feature (27)..(27): n = unknown
  misc_feature (200)..(200): n = unknown
  misc_feature (472)..(472): n = unknown
taataagcagttgggaacattttgtcncgattgttctactttgaagttgtgcgctggacaagaaaccccaattacaacaatcaattgcagagactcaaattccgatgctccattttgtgtagatgatatgtgctcatcaaaacctggggaaaactgtaagacggcagaaactacatgcgcggttgtaggatatcagccanatccgaaagactgcacaagatacttattctgcaaagatggtaaaggtcaggttttcgaatgcccacctaactatgtatatgatcattctaaaaatatgtgtaaaaagaaatcgtcagaagctgattgcaccgtcatgaaatgcacaaatcccaattcttttatacctatgcaccggacccatcaatttatgcttggtgcaatgacaaattgcaacccgatcgtactgaaatgtgaagacgacgtcaacgaatggtttgacccaaaatctttntcgtgcagaactgcatgcaaaagtga

SEQ ID NO: 1730 - DNA, 500 bp, Ctenocephalides felis
  misc_feature (30)..(30): n = unknown
  misc_feature (58)..(58): n = unknown
  misc_feature (158)..(158): n = unknown
  misc_feature (207)..(207): n = unknown
  misc_feature (441)..(441): n = unknown
  misc_feature (469)..(469): n = unknown
  misc_feature (496)..(496): n = unknown
ttttttttttttttttttttttttgaacgncccaaacgatttatttttattaaaaagntacatgtaatttcataaagcttctatatttatatattttaaataatcagaaattactatagttaatgacattttgtttgtgctccttacataaaatacanttttatacattttaatttttatacatattttttatatttaattgcacanatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccattggtgttaaccaagaaacattgataatatttnttacaatctcttcgatcggaaaaaacgntttcctttgcatgcagttctgcacganaaag

SEQ ID NO: 1731 - DNA, 498 bp, Ctenocephalides felis
  misc_feature (103)..(103): n = unknown
  misc_feature (376)..(376): n = unknown
  misc_feature (467)..(467): n = unknown
  misc_feature (485)..(485): n = unknown
tgattgcgggtgctctggaggaaccaaaaaccttctcactttataagggcttcatacatctgggcgctggtttggccgtaggattttccggcttggcggcggnttttgcgattggaatcgttggtgatgctggagtacgaggaacagcccaacaacctcgtctgtttgttggaatgatcttgatcctgatcttcgctgaagtattgggtctatatggtcttatcgtagccatctacctctacaccaaataaacaaattattatggatttcaagatacacaagtcgcctgcctcccaaatcccctaatatatatgcagcagtgcagtctgtctattatttttgccactcacacttaaaaatatagtggctgtaccgntatttatattatattgcttatacagaaagcactgttgtatgaaaagtatctgaaatcaacacatctcatgtaagggtactttattgtaaangttattttatatgtaatnttttaataacatt

SEQ ID NO: 1732 - DNA, 500 bp, Ctenocephalides felis
  misc_feature (65)..(65): n = unknown
  misc_feature (85)..(85): n = unknown
  misc_feature (134)..(134): n = unknown
  misc_feature (484)..(484): n = unknown
  misc_feature (487)..(487): n = unknown
aaagcttctatatttatatattttaaataatcagatattactatagttaatgacattttgtttgngctccttacataaaatacanttttatacattttaatttttatacatattttttatatttaattgcacanatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtacaagccatttggacaatcataatgttttatttgccatttgttgttaaccaagaaacattgataatattttttacaatctcttcgatcggaaaaaacgttttcacttttgcatgcacttctgcacgagaaagattttgggtcaaaccattcggtgacgtcggcttcacatttcaagtacccttggncgngaccccgctaagc

SEQ ID NO: 1733 - DNA, 159 bp, Ctenocephalides felis
  misc_feature (30)..(30): n = unknown
atacatataaattactgattttgctaaatntatcagtcgccttagattgtaaaaagtgaaaaagccagaacacaagtgtagacaccagaatcagagtttaatcttaccagaaatatgtggagcgtgtgaattatgtaaatatttgtgcaacgcatatgt

SEQ ID NO: 1734 - DNA, 500 bp, Ctenocephalides felis
  misc_feature (17)..(17): n = unknown
  misc_feature (142)..(142): n = unknown
  misc_feature (164)..(164): n = unknown
  misc_feature (213)..(213): n = unknown
  misc_feature (220)..(220): n = unknown
  misc_feature (222)..(222): n = unknown
  misc_feature (259)..(259): n = unknown
  misc_feature (340)..(340): n = unknown
  misc_feature (495)..(495): n = unknown
ttttttttttttttttntttttttttttttgaacggcccaaacgatttatttttattgaaaagatacatgtactttcataaagcttctatatttatatattttaaataatcagaaattactatagttaatgacattttgttngtgctccttacataaaatacanttttatacattttaatttttatacatattttttatatttaattgcacanatcattngngtatttattatattaattgactactttatgataattngaatcctaattagtctattcaagattgttttcctggtttaagccttacttagcaatctcacttttgcattcttcgccgggnggcgtgggtatgcatcgcaactccgttttatcaaagtgcaagccatttggacaatcataatgttttatttgccatttgttggcaaccaagaaacattgataatattttttacaatctctttcgatcggaaaaaaacgttttcacttttgcatgcncgttt

SEQ ID NO: 1735 - DNA, 486 bp, Ctenocephalides felis
  misc_feature (434)..(434): n = unknown
  misc_feature (477)..(477): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaatatgtataaaaattaaaatgtataaaattgtattttatgtaaggagcacaaacaaaatgtcattaactatagtantttctgattatttaaaatatataaatatagaagctttatgaanggtaaaaaa

SEQ ID NO: 1736 - DNA, 474 bp, Ctenocephalides felis
  misc_feature (65)..(65): n = unknown
  misc_feature (85)..(85): n = unknown
  misc_feature (134)..(134): n = unknown
aaagcttctatatttatatattttaaataatcagatattactatagttaatgacattttgtttgngctccttacataaaatacanttttatacattttaatttttatacatattttttatatttaattgcacanatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtacaagccatttggacaatcataatgttttatttgccatttgttgttaaccaagaaacattgataatattttttacaatctcttcgatcggaaaaaaccgttttcacttttgcatgcagttcttgcacgagaaagattttgggtcaaaccattcggtgacgtcgtcttcacatttca

SEQ ID NO: 1737 - DNA, 294 bp, Ctenocephalides felis
  misc_feature (34)..(34): n = unknown
catcgccagagccttcgaataaagcagaatactnagcataatattcagctacagctttaacttgttcataatcatcagcacgagccagagcagctaaaccgtctgggtttagtttaccacaacgggggtacaatttagcacgatcatccttgctcaattcagttccaaacgagttgattgttatgattatggcacgtctgtcagcttcaaaagctaatatttcacacattgtatcagctgtggatccaccaagtcccttgcaaaactcataaaatgcctcaagataggctttgt

SEQ ID NO: 1738 - DNA, 361 bp, Ctenocephalides felis
  misc_feature (285)..(285): n = unknown
  misc_feature (325)..(325): n = unknown
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattanttttatagatgaacaaatacataatctaataaaccagcangtgaacttcaaaaaaaaaaaaaaaaaaaaaaaaaaa

SEQ ID NO: 1739 - DNA, 259 bp, Ctenocephalides felis
  misc_feature (93)..(93): n = unknown
tcttccatcatggagaacatttggggtaaccacaatcttaaagtattcaaccccaataaagccagaagttgtatagcacacacgatgatgcantttttcaaatgtggtgcataaaataaaggcttgaattgtttgaaaccagctttaagagcttccattccttcaggtttgggagaaccatcttgtccattggctttggtttcttccaccagttgttttattggatattcagtcttgtcattccaatgattaatcctgt

SEQ ID NO: 1740 - DNA, 361 bp, Ctenocephalides felis
  misc_feature (33)..(33): n = unknown
  misc_feature (53)..(53): n = unknown
aaaatcgaatcgttggtggcaatgatgtaagtntttcaaaaaatgggtggcangtatcagttcaaagtaataaccaacatttctgtggtggttcaatcattgctaaagattgggtgctgacttcttctcaatgcgtcgtggacaaacaaagtccaccgaaggatttaactgttcgtgttggaactagcactcacaatgatggaggaaaagtgtatgatgttattgaaattataaaacatccgaaatataataaagcagtgccagatgattttgatgttgcacttttacggatcaaagagccaatatcatttactccatgcacagtaactcctgtaaaattaatacaatcgggaaaagaagt

SEQ ID NO: 1741 - DNA, 480 bp, Ctenocephalides felis
  misc_feature (26)..(26): n = unknown
  misc_feature (52)..(52): n = unknown
  misc_feature (80)..(80): n = unknown
  misc_feature (92)..(92): n = unknown
  misc_feature (104)..(104): n = unknown
  misc_feature (165)..(165): n = unknown
  misc_feature (198)..(199): n = unknown
  misc_feature (243)..(243): n = unknown
  misc_feature (297)..(297): n = unknown
  misc_feature (333)..(333): n = unknown
  misc_feature (351)..(351): n = unknown
  misc_feature (380)..(380): n = unknown
  misc_feature (386)..(386): n = unknown
  misc_feature (394)..(395): n = unknown
  misc_feature (431)..(431): n = unknown
  misc_feature (436)..(436): n = unknown
  misc_feature (444)..(444): n = unknown
  misc_feature (452)..(452): n = unknown
tttttttttttttttttttttttttnacggtttatgaaatttattcatattngtttttatacataatattatataattanttttacaaatgngttttataaatnttgttgatattaggataggttgacagtaggattctttagtagaacatgttttatttaatanctctacataatatcaacacctttaaaaatacannttcttttattaccaggattgaaataatactttatcattcgtatntttataatagtaaacgtaaacttcaaattttgagagaaacatcagctcaccttntcatcaatcagaaaaatgatatcagcaaaacaaagnaatctaagaaaaagtcgntttgaaactcattaaagtttaaataaggntttggntttttcgnnttttcgaaattaatattaatgtttctgaaaactaangttcnctttgagnccaaatgncctagatattcgatcatttttaaaataa

SEQ ID NO: 1742 - DNA, 386 bp, Ctenocephalides felis; identical to SEQ ID NO: 354

SEQ ID NO: 1743 - DNA, 131 bp, Ctenocephalides felis; identical to SEQ ID NO: 515

SEQ ID NO: 1744 - DNA, 131 bp, Ctenocephalides felis
  misc_feature (34)..(35): n = unknown
cttttgcatgtaggatccaatggatcgcgaaatnntccaactcttggacaaatgaatggttgctgccaaatacgaacgctgctggaatttgtttcaactggaattagttcttgagactccaaagacaatgt

SEQ ID NO: 1745 - DNA, 323 bp, Ctenocephalides felis
gggaacgaaaagaatcggccaaatgcatgcaaaaggttgcattaaatatacaactagcagcagccagagtttcaactgatgttggcattaaagtaggagaagccctcaggaatgtagtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaactaaaaaaaaaaaaaaaaaaaa

SEQ ID NO: 1746 - DNA, 498 bp, Ctenocephalides felis
  misc_feature (62)..(62): n = unknown
  misc_feature (85)..(85): n = unknown
  misc_feature (122)..(122): n = unknown
  misc_feature (156)..(156): n = unknown
  misc_feature (405)..(405): n = unknown
ttttttttttttttaatttcataaagcttctatttttatatattttaaataatcagaaattncgatagttaatgacatttcgttngtgctccttacataaaatacacttttatacattttantttttatacatattttttatatttaattgcacanatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcnatcggaaaaaaccgttttcacttttgcatgcagttctgcacgagaaagattttgggtcaaaccattcgttgccgtcgtcttcacatttcaagt

SEQ ID NO: 1747 - DNA, 498 bp, Ctenocephalides felis
  misc_feature (34)..(34): n = unknown
ggatatctggcgtcatatgtggttcccaagtatncaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaataccgtcacggaacatacaatccagcaaagcacaataagtgtagtatttctagctaaacgtaaactagaaaataaactcatgattccgta

SEQ ID NO: 1748 - DNA, 498 bp, Ctenocephalides felis
  misc_feature (28)..(28): n = unknown
  misc_feature (150)..(150): n = unknown
cttattcctaaagctagtaatgccgaangtaaggttttctatcttaagatgaagggagattactacaggtatctagctgaagtagcaacaggagaaacccgtaacaccgtcgtagatgattcacagaaagcttatcaagatgcatttganatcagcaaggccaaaatgcagcctacacatcctattagattgggtcttgcacttaacttttccgtattttattatgaaatactaaattcacctgataaagcgtgtcaacttgcgaaacaggcattcgatgatgcgatagcagagctcgataccctaaatgaagattcatataaagattcaactctcataatgcaattgctgcgagataacttaacactgtgggacatcagacacgcagggtgatgggagatgagcctcaggaaggcggggacaactagtcctgaaaaccttacctatccacttccgtatccttaattcacccttatacaatcccttcgttatttggta

SEQ ID NO: 1749 - DNA, 215 bp, Ctenocephalides felis
agactgaccctgggcccaggcgtttgcttaacagtgacgttaaaggcgaccaaccaccgtcaacgaatgatgaaataagcccatccacaactgctccaagttcaaacgtgaatgaaagcaatggaaacctcaccaaatcacaacccttaagccaaaatacttcaacaaatactccattagaaacatcaaatacctcactagcagaaagcagcagt

SEQ ID NO: 1750 - DNA, 207 bp, Ctenocephalides felis
agagaggattcaggaaagctcttcttcgtcgcctgattttggagccgagttggttcaaccaattcaccaggatcgtgaatctaatgaacatgaagaacaattcaacaagcaccatcatcacaagcaacacaaagctgattatatgaatcacatgagagtcaccgacacttcggcaatcatggctggttcttttgctgtgatagcggt

SEQ ID NO: 1751 - DNA, 386 bp, Ctenocephalides felis
  misc_feature (27)..(28): n = unknown
acatatcttacatcgaatctaataacnntaaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1752 - DNA, 498 bp, Ctenocephalides felis; identical to SEQ ID NO: 464

SEQ ID NO: 1753 - DNA, 210 bp, Ctenocephalides felis
  misc_feature (12)..(12): n = unknown
  misc_feature (26)..(26): n = unknown
  misc_feature (57)..(57): n = unknown
  misc_feature (78)..(78): n = unknown
  misc_feature (135)..(135): n = unknown
aaggtttcaaangtccgtcaccatcnttattttatccaaatataaatgattgtcagngctattattattgtgacgaanatagtataggaacccaatattattgccccgcaaattttgcatatgatccgttacgtnataattgcggacctatggctctgggcacaaaatgctatacagttacatgtcctgcacagcctaaggtgcttccgt

SEQ ID NO: 1754 - DNA, 498 bp, Ctenocephalides felis
  misc_feature (29)..(29): n = unknown
tttgtttttcttttaattgatgcttgctnatagaataatgtaaattccgggcaatctgtagcggaaaccaggaaatataatccagctaaaacttgacctttggtatcacgtgccagtaatgaacggaagttgtatactaaattacgccttactgtcacatccactgcagtataataaggtttatgcacatatactagagataccactagatttgtagttgttcctccttctttaatagttctgtgttgtcgttcatgccattcaacataatgagaagattgagtgctataagcatagcaatattcgcgtttgcttccacctggcccttcatcacattgtgtaaaccaacccgtatgtggatatttttcatcagccattactgtcactactcttgcgacgtgatatcctggatcacaaaggactacaccttttctttcatttatgcaaatcgaatagcaaccatacgtgttctttttctaaggcgccgcctggagccct

SEQ ID NO: 1755 - DNA, 396 bp, Ctenocephalides felis
  misc_feature (29)..(29): n = unknown
  misc_feature (163)..(163): n = unknown
ttagcccaagtttcacagcaggtttggcngtcactataatagtatgctccctttcattttcccctgaaccaactttgcatgtgtaagagccagcatcatcttgttcagttttttcaataatgaattgatgttcttcctttattaattgataacggtccttganatcattgatttcttctacttttttctcatctttaaaccactgatcaacaggaccatctttcaatggacaggttagaaccaatggactgcgaatatcaaaaagtttttgcgacgtggcttcaccttctctggcataaacactgctttggaccaaaaataataaaattgcactacacaaaaactgcttcatatttattgaattttcttcccctcgattgaaatagttcataaagt

SEQ ID NO: 1756 - DNA, 232 bp, Ctenocephalides felis
  misc_feature (33)..(34): n = unknown
  misc_feature (75)..(75): n = unknown
tgtaaacagcactttgcctttgtaggttttgtnnaaggcttcgcttaaagttttgatggctttggtgagctctgntttggctttgtcggtgtcttcgggggatttgaaatttgttgataagcggaagaagaacaggctagggcgctcatcaggggttagttccaaaactttgtcagataaagcgttgaggacacccaagtctttcacaaacttctctggtaaatcactttgt

SEQ ID NO: 1757 - DNA, 475 bp, Ctenocephalides felis
  misc_feature (61)..(61): n = unknown
  misc_feature (429)..(429): n = unknown
ccgtatttggaaaagtgatgtataaaaaagtgtgtgctttgatggaaaataatatttgatnaaggattgcaaaaagactgacagatttgtaatacagattttggacatttggacttttaatattttaaatatatttggaaccataagttttgtgctcggggacgtcacttaatcacgtaatcgatttttttgaaaatttttgaaatcccctttcccctctgtgaaaccgtatattgaaaattaccctcctccgaaaaaaatcgtaaaattttcaattttttttttttttttgaaaatgtttgcaatctttattacaaatctcagtttaattttgtcaactaatttggacctacggtaattataaagtatcctatattagcccactgtaccaattatagtaaatttaattactaattattcatcatttgnggcaccgtcagcttgtaattagtaattaaaatttactataattggt

SEQ ID NO: 1758 - DNA, 500 bp, Ctenocephalides felis
  misc_feature (23)..(23): n = unknown
  misc_feature (32)..(32): n = unknown
  misc_feature (60)..(60): n = unknown
  misc_feature (267)..(267): n = unknown
tttttttttttttcttgtaactntatattttntattgctatgtatatacacaatatgatnaaattttaacagttaaattgaatttattagattatataaaactgaaaattatcatggaatgtaatttaaaatcatacagaaaaaaacaaatataataataaaatttgataatatttcaacaacttgtagctagtacggcagaatactgtttcacaacaacatactttcattttaacaatagaatcattattttataagtatctacantttctttaaacattaaaacatgtcttcatgttttccttacattaaggatgtggttagtaccagacatcccaaaaactgatttaatattctttacatggagaagacaacatataaagggaaataaaatatggtattgatggaaactttagtaagatttttaatgacgagaatcacgtgggtaaaactcggcgagggtggaagcgggtattctcttcaacatctcctggggaaga

SEQ ID NO: 1759 - DNA, 498 bp, Ctenocephalides felis
  misc_feature (49)..(49): n = unknown
ttaagacttcttctctacacatccaattcatacaaaacttctaaagtanatccaaaagaatcgaacaatatcttcaaattgaagaattttatcaaatatatactgtaaaagaaatgtgtaaagggttcatttgcaatgcactactatgaaagtaggcatacatagagtgatgaaagctagctgatacggattattcaactctcacgatttcagaaatcaaccatggcatgcgtttcggtttccaatttagtgacatcacatgaatgcaaatcacatatagaagacggacgtatagacataatttgttgcaaaatttaaaccatctggaaaggttttaatcatgaaaatatgcaattattattaaagtattataaatgcagatatcctgtttccagttgtgaacagttccgactttaaatggtggtgacaaatgatttaagttaaacataagcaagttcctcaaactcagagtcattatgctcttataattaattccat

SEQ ID NO: 1760 - DNA, 295 bp, Ctenocephalides felis
  misc_feature (35)..(35): n = unknown
  misc_feature (147)..(147): n = unknown
cttcaattcataaagaaaaaaaaacaaattatcangttctgaaataaaaagaaaacttttcaccaaacgtcatacagacactatatttgctaactgttggatctgtaataaaatttatcttttaatattaaattcattttatacggngtatatgtaactgcaatcctattatatttgaagaaacacatatgtaagaaatgcaataccgatgaaaaaattcgatatcggtatttcgcttttataagcggtaatattattattttatgaggtgtaaacaaaattaaaattgacttgt

SEQ ID NO: 1761 - DNA, 498 bp, Ctenocephalides felis
  misc_feature (29)..(29): n = unknown
  misc_feature (411)..(411): n = unknown
  misc_feature (482)..(482): n = unknown
  misc_feature (490)..(490): n = unknown
tttgtttttcttttaattgatgcttgctnatagaataatgtaaattccgggcaatctgtagcggaaaccaggaaatataatccagctaaaacttgacctttggtatcacgtgccagtaatgaacggaagttgtatactaaattacgccttactgtcacatccactgcagtataataaggtttatgcacatatactagagataccactagatttgtagttgttcctccttctttaatagttctgtgttgtcgttcatgccattcaacataatgagaagattgagtgctataagcatagcaatattcgcgtttgcttccacctggcccttcatcacattgtgtaaaccaacccgtatgtggatatttttcatcaagccattactgtcactactcttgcgacgtgatatcctgnatcacaaaggactacaccttttcttcatttatgcaaatcgaatagcaaccataacgtgttctttttctaangcgcccgnctgggagc

SEQ ID NO: 1762 - DNA, 409 bp, Ctenocephalides felis
  misc_feature (14)..(14): n = unknown
  misc_feature (29)..(29): n = unknown
  misc_feature (72)..(72): n = unknown
  misc_feature (101)..(101): n = unknown
  misc_feature (117)..(117): n = unknown
  misc_feature (150)..(150): n = unknown
  misc_feature (293)..(293): n = unknown
  misc_feature (295)..(295): n = unknown
  misc_feature (335)..(335): n = unknown
  misc_feature (351)..(351): n = unknown
  misc_feature (409)..(409): n = unknown
gcaatttatgacantattatacaatggtnacatccgaaagtataatgaatgtattaagatataaattaaagngcgtttttactatttttattttttatgtnaaaatatttaataaantattaagtatttttataaagattattgcatgtntggattcatgagcaataagttctaatatagttcttaaccatacagtcactacatagcctaaatcgtccttttgacaaaataatactttcacaaacacttttcacaaaattcttacgagtcagttttattcgaagtgtcgctgntnttacgaataatatctacattgctcgcctttttttcttggngcctagtataagccanatcacttgttggaattgaatttttagtgataacaatacgaggtttttctgtcattggn

SEQ ID NO: 1763 - DNA, 498 bp, Ctenocephalides felis
  misc_feature (93)..(93): n = unknown
  misc_feature (262)..(263): n = unknown
  misc_feature (425)..(425): n = unknown
  misc_feature (457)..(457): n = unknown
  misc_feature (460)..(460): n = unknown
  misc_feature (479)..(479): n = unknown
  misc_feature (486)..(486): n = unknown
  misc_feature (494)..(495): n = unknown
ttggaattcttgacgaaatttgagaagaactttatctcacagggtaattatgagaaccgcacagtatttgaatctttggacattggctggcanttgttgtgtaccttccccaaggagatgttgaagagaatacccgcttccaccctcgccgagttttgcccacgtgattctcgtcattaaaaatcttactaaagtttccatcaataccatattttatttccctttatatgatgtcttctccatgtaaagaatattaaatcannttttgggatgtctggtactaaccacatccttaatgtaaggaaaacatgaagacatgttttaatgtttaaagaaattgtagatcttataaaataatgattctattgttaaaatgaaagtatgttgttgtgaaacaagtattctgccgtactagctacaagttngtgaaatattatcaaattttattattatattngcncttctggatgaatttaaantacattncatgatannttt

SEQ ID NO: 1764 - DNA, 173 bp, Ctenocephalides felis; identical to SEQ ID NO: 395

SEQ ID NO: 1765 - DNA, 231 bp, Ctenocephalides felis
  misc_feature (33)..(34): n = unknown
tgtaaacagcactttgcctttgtaggttttatnnaaggcttcgctcaaggttttgatggctttggtgagttcagttttggctttgtcggtttcttcgggggatttgaaatttgttgctaagcggaagaagaataagctaggacgttcatcaggggttagttctaagactttgtcagataaagcgttgaggacaccaggtctttcacaaacttctctggtaaatcactttgt

SEQ ID NO: 1766 - DNA, 498 bp, Ctenocephalides felis
  misc_feature (391)..(392): n = unknown
  misc_feature (494)..(494): n = unknown
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcctgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgnnttttatgtaaggagcacaaacaaaatgtcattaactatagtaatttctgattatttaaaatatataaatatagaagctttatgaaattacatgttctttttnataa

SEQ ID NO: 1767 - DNA, 498 bp, Ctenocephalides felis
  misc_feature (73)..(73): n = unknown
  misc_feature (163)..(163): n = unknown
  misc_feature (172)..(172): n = unknown
  misc_feature (361)..(361): n = unknown
  misc_feature (372)..(372): n = unknown
  misc_feature (434)..(434): n = unknown
  misc_feature (460)..(460): n = unknown
gatgaaatcaagaaattgttgtaaattaagcaataaacaaccataacaaaaaaagagaaaaatctaaaaacantttaaattagcaaaaccaagtgtatttgaatttcatttttgcacaagttacctttttgtattaaaatatatgtatatttatgaatatgtntttcttgtnttttaggttaaattcgttatagaataatttggaaatacatattcataatgctaaagtattaaattggcttttttccattaaaatcctatttaacattatacatatattttattgtcaaatgtgaggcggtatggaatcacgggtggctgctttctgagtagtcgaaccttttaggcaaaaattgtgtanatcaaactcanttctacaatcttgagctcatccacattctcagaacatccatgtatttaaggtaacttattgnatttaacagcttttgaggaaatctgnaaatatgtttaagataaatcaagtaaaaatggcgaata

SEQ ID NO: 1768 - DNA, 498 bp, Ctenocephalides felis
  misc_feature (33)..(33): n = unknown
  misc_feature (486)..(486): n = unknown
  misc_feature (498)..(498): n = unknown
aacatttcagactttgcacgtccagactgcatnatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggtacaatccagggagaccatcagacttgaagattttggtcaagcagttgcccaatccagagaattcacgttgaccagcgcctttacctacatcagcggccaatctggtacgggcgaaatcaagtgggtagacgaagcacaatgatgtggctccagcagcaccaccagatgccaagtttcctgcgaagtaacgccagaattgggtcttcttgtcaactccacccaagaaaacttgcttgtcttgtctttgaatgcgaagntcaaagcctgan

SEQ ID NO: 1769 - DNA, 352 bp, Ctenocephalides felis
  misc_feature (28)..(29): n = unknown
  misc_feature (268)..(268): n = unknown
tgataaattgcctgcaagaatgagtttnngggaacgaaaagaatcggccaaatgcatgcaaaaggttgcattaaatatacaactagcagcagccagagtttcaactgatgttggcattaaagtaggagaagccctcaggaatgtagtggaacttcgtttagatttgggaaaatgttcttcagacaatttgaataaatgggaatccagattggaagaaattaatgatgttgtggaaaattgcatcgtgtgaaattgtaacttgaaatantttttcttaactattagttttatagatgaacaaatacataatctaataaaccagcaagtgaactaaaaaaaaaaaaaaaaaaaa

SEQ ID NO: 1770 - DNA, 411 bp, Ctenocephalides felis
  misc_feature (29)..(29): n = unknown
tttgtttttcttttaattgatgcttgctnatagaataatgtaaattccgggcaatctgtagcggaaaccaggaaatataatccagctaaaacttgacctttggtatcacgtgccagtaatgaacggaagttgtatactaaattacgccttactgtcacatccactgcagtataataaggtttatgcacatatactagagataccactagatttgtagttgttcctccttctttaatagttctgtgttgtcgttcatgccattcaacataatgagaagattgagtgctataagcatagcaatattcgcgtttgcttccacctggcccttcatcacattgtgtaaaccaacccgtatgtggatatttttcatcaagccattactgtcactactcttgcgacgtgatatcctgc

SEQ ID NO: 1771 - DNA, 498 bp, Ctenocephalides felis
  misc_feature (442)..(442): n = unknown
  misc_feature (475)..(475): n = unknown
  misc_feature (490)..(490): n = unknown
aacctttaaactaatactacaaatccgacttatataaactatatattacttttcaaatttatgtaactaaatttggttcaattaacagccttttaatagcacttacatatttcactactataataattagaaatgtgttaaaataaaattcaagctctaattactttgtcgatacaagctctattttcattccatgtcataataagatcatgtcttcattttgaatgtcaaatgtacatatcattttctcagctaataattatacattatgattatgaaataatggttaaattagattatagttgacttcctacatgtagaaattagacacagtagaaataaaacatggatatatctttggagaatcttaaactctaagcaattataaattaggaaacgttaaataattgcaacaatttacatatcctatatattatcatgnaaaacgcaaatatattagcacacataaaatagngaaataaataatcgngcaaatat

SEQ ID NO: 1772 - DNA, 500 bp, Ctenocephalides felis
  misc_feature (14)..(14): n = unknown
  misc_feature (59)..(59): n = unknown
  misc_feature (71)..(71): n = unknown
  misc_feature (132)..(132): n = unknown
  misc_feature (162)..(162): n = unknown
  misc_feature (211)..(211): n = unknown
  misc_feature (401)..(401): n = unknown
  misc_feature (420)..(420): n = unknown
  misc_feature (422)..(422): n = unknown
  misc_feature (428)..(428): n = unknown
  misc_feature (437)..(437): n = unknown
  misc_feature (463)..(463): n = unknown
  misc_feature (495)..(495): n = unknown
tttttttttttttnttttttttttttttgtacggcccaaacgatttatttttattaaanagatacatgtantttcataaagcttctatatttatatattttaaataatcagaaattactatagttaatgacnttttgtttgtgctccttacataaaatacanttttatacattttaatttttatacatattttttatatttaattgcacanatcatttgggtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgntttatttgccatttggtgntnaccaanaaacattgntaatattttttacaatctcttcgatngggaaaaacgttttccttttgcatgccgtttntgcac

SEQ ID NO: 1773 - DNA, 469 bp, Ctenocephalides felis
  misc_feature (57)..(57): n = unknown
  misc_feature (240)..(240): n = unknown
aactttgtcttttaccaaaagtccttacatcaactcggtatactcataatttaatantttttaattgatgtcgaccctacgttgtcgcaatgtttactaactttcaaattcttgtaacttttaaactgtttgtttaatttaaatgaaatatttggcaaatttgttcaaaattaaatagtctataactttttctaacatcctaagtccatagagcaactcggtatactgaaaaattaatanttttaaattgatgtcgacactacgttgtcgcaatgtttactaactttaaaattcttgtaacttttgaatggtttgtttaatttgaatgaaatatttggcaaatttgtttgaaattaaataatttacaactttgtctaacatcttaagtccatagagcaactcggtatactcataaattaataatttctgattgatttcctgaaagatttactttgtaattggtgaaagt

SEQ ID NO: 1774 - DNA, 251 bp, Ctenocephalides felis
tttccgtaatgatgatggtgggcgcgacttccggaatgttcttgccggaaactttacaccaaaagttaccggaaacgctaactgaagctcacgtattcggcagggatcaggtgttctggagcttaccgaaaaaaggtgtatcaaagtctacagatacggccgtcaagaaattatcacaagaagactgttaaatagttataatttgtattgttatacatatgcttcttatataataaaattatatttattgt

SEQ ID NO: 1775 - DNA, 410 bp, Ctenocephalides felis
aaatacagaggttcacagaagcattcagacaacgagattcccaacaaacaggaaccataacaatagctttcgaagattttctcaatgttgctttaagttgttctatttaaaaaaaaatcattgttaacaataaagatttaaaaattttcataagtattaaataaatttcacacacaactttgtgtattaaaagggtttttattatcaattagttaataaaataactactaaaattgtaaatgaaatttttattgtatatataaaattgaaatacctacattttgtatgcagatgttataactgattgtaagtgaaccaattattgtaaggaatatgggacgccatattttcactcatttttttacactttaactataatgtaacagaaattatagtgttattccatttgt

SEQ ID NO: 1776 - DNA, 386 bp, Ctenocephalides felis
  misc_feature (35)..(35): n = unknown
  misc_feature (360)..(360): n = unknown
cctacacaactcagggcaatggcagtatgtatatntttaatgatgggtcgattaggaagtgttgttggaagcaatgttgtaggaataattctagattataattgcgatttaacatttttaatatcaggagcatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgntattagattcgatgtaagatatatgt

SEQ ID NO: 1777 - DNA, 285 bp, Ctenocephalides felis; identical to SEQ ID NO: 1210

SEQ ID NO: 1778 - DNA, 498 bp, Ctenocephalides felis
  misc_feature (58)..(58): n = unknown
  misc_feature (95)..(95): n = unknown
  misc_feature (210)..(210): n = unknown
  misc_feature (227)..(227): n = unknown
  misc_feature (349)..(349): n = unknown
ctagtgagtgtgttatatgaaattgcttttgcatattacatacaagcttaataaaggntatggtgatttatttcatttaaaggcaatgtatcggnttaatggttttaaatttattttttatttaatattaaatagattaattaaaaatctataaagtgataagaggcctgatatccataatattattgaatattaagaagtgacggatanatctgataatgtagtanttgttatagacaatttacttaataattatgagttgcatcattatgcaatgatttatcactattatttattcaacattttatttaactgcttgcaacttttaataaaacgcattttttattgntttaagtataaatcttattagggcacaatatgaaaataaaaataagaactttatcaaaagctttttttatacaatatgcttcttgcgctattaagttaagaaattttatttatgcttgtaaaaaaacaataaatgcttatttattaaaa

SEQ ID NO: 1779 - DNA, 496 bp, Ctenocephalides felis
  misc_feature (43)..(43): n = unknown
  misc_feature (55)..(55): n = unknown
  misc_feature (59)..(59): n = unknown
  misc_feature (64)..(64): n = unknown
  misc_feature (150)..(150): n = unknown
  misc_feature (284)..(284): n = unknown
  misc_feature (318)..(319): n = unknown
  misc_feature (394)..(394): n = unknown
  misc_feature (403)..(404): n = unknown
  misc_feature (474)..(474): n = unknown
tcccctttttttttttttttttttatatatcatataagttatntttcggtatacntttnggggnttgtggtccatattttaatttgctacttaacatattctatgattatggatttattcaaaattaatttatccaaacagcttataaanttgtatttatcttttatccattcaacaataaaatgttaacaaaaaaatacacatagaaatcttttcagacatggccatttaaacattttttcattaaggttatcaaaaatatatcaggcatggccatttatacntttttttattagagtcatcaaaaaaatagtatannttctatgttattattcaaaatctatacattaataaggatgttagaagtttgttcggttaattttcaggcagaggntgctattgnngtaatagaacaattttaatcatctaaaatttgattaatctattacccttaatcattcaataggaaacttncttttggaatttcgaatgggtg

SEQ ID NO: 1780 - DNA, 418 bp, Ctenocephalides felis
  misc_feature (81)..(81): n = unknown
  misc_feature (409)..(409): n = unknown
aaaatcttaatctgaagcaatgtggattggtttatatttgcattgtagatatattaataaaattttaagagtttagcatanttttagattattgatcgtaaacacttaaagatcttgtctgttgtcaaaattttcctaggggttgacgccttatttttgtgcaaattgttgtaaggcgtaagttccatggattatattatggcttaagatatcacgtcgacctcattccacttaatagattcatcatttttcatgttggagttcgatgcatatttttactataatacattaaaaactgaaaatttgtcttttattttgtagagtgaaatgctgagtatttgtagattatttgtaatgtaaatttactaagtaataaattgttaataattattggtagaatgacctaccnaaaaaaaaa

SEQ ID NO: 1781 - DNA, 386 bp, Ctenocephalides felis
  misc_feature (63)..(63): n = unknown
  misc_feature (360)..(360): n = unknown
cctacacaactcagggcaatggcagtatgtatatctttaatgatgggtcgattaggaagtgtngttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagaagttgctactgaatcattttctaaaacatcgacatgaaaattaataactctttattgntattagattcgatggaagatatatgt

SEQ ID NO: 1782 - DNA, 438 bp, Ctenocephalides felis
  misc_feature (335)..(335): n = unknown
  misc_feature (338)..(338): n = unknown
ttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgntgntaaccaagaaacattgataatattttttacaatctcttcgatcggaaaaaacgtttcacttttgcatgcagttctgcacgagaaagaatttgggtcaaac

SEQ ID NO: 1783 - DNA, 414 bp, Ctenocephalides felis
  misc_feature (11)..(11): n = unknown
  misc_feature (98)..(98): n = unknown
  misc_feature (107)..(107): n = unknown
  misc_feature (158)..(158): n = unknown
  misc_feature (230)..(230): n = unknown
  misc_feature (257)..(257): n = unknown
  misc_feature (288)..(288): n = unknown
  misc_feature (347)..(347): n = unknown
  misc_feature (353)..(353): n = unknown
  misc_feature (390)..(390): n = unknown
attactatagntaatgacattttgtttgtgctccttacataaaatacaattttatacattttaatttttatacatattttttatatttaattgcacanatcatttgngtatttattatattaattgactactttatgataatttgaatcctaattagnctattcaagattgttttcctggtttaagccttacttagcaatctcacttttgcattcttcgccgggtggcgngggtatgcatcgcaactccgttttatnaaagtgcaagccatttggacaatcataatgntttatttgccatttgttgttaaccaagaaacattgataatattttttacaatctctttnatcggnaaaaacgttttcactttgcatgcagttctgcaccganaaagattttggggaaaaccattcg

SEQ ID NO: 1784 - DNA, 187 bp, Ctenocephalides felis
tttgcagactgtactttctttagtggtgttctgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggt

SEQ ID NO: 1785 - DNA, 500 bp, Ctenocephalides felis
  misc_feature (60)..(62): n = unknown
  misc_feature (82)..(82): n = unknown
  misc_feature (456)..(456): n = unknown
ttttttttttttttttttttttaagctttctttcatttgtattttattcaaataaatatnnntaaaaatcataattcgacanttttacttgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatcaagaaatacatattcataaatatacatatattttaatacaaaaaggtaacttgngcaaaaatgaaattcaaatcccttggttttggttaattaaattg

SEQ ID NO: 1786 - DNA, 275 bp, Ctenocephalides felis
  misc_feature (68)..(68): n = unknown
  misc_feature (70)..(70): n = unknown
  misc_feature (113)..(113): n = unknown
agggttttttgcattctgaatgattttattcttttatgtttaaaatacaaaatataatacaatttatngntgtagcttattgtatttctaatgaagtcttaactatgccatantttttaaagtgtattatgtagtcctaattgtaatttaatataaatataaactttatttagcagtaaatttaattaagaaagtgcataccaactttcataatgaatttaattttttttttttactgaaatatactctactctaaattaataattgtggtatgt

SEQ ID NO: 1787 - DNA, 444 bp, Ctenocephalides felis
  misc_feature (61)..(61): n = unknown
  misc_feature (64)..(64): n = unknown
  misc_feature (374)..(374): n = unknown
  misc_feature (382)..(382): n = unknown
ttttttttttttttttttttttgatttcataatttttctatatttatatattttaaataanggngaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgntaaccaanaaacattgataatattttttacaatctcttccatcggaaaaaaccgttttcacttttgcatg

SEQ ID NO: 1788 - DNA, 498 bp, Ctenocephalides felis
  misc_feature (28)..(28): n = unknown
  misc_feature (486)..(486): n = unknown
agtaagaagtaacttaaaccgcaaactncccagcatatcaataacattattgtgttcttggcgagcgtccagcttgtgaacaaactcatcattccaaaaacatgttcaggttcagacgaataatcttttagcatttctaatgcatcatcattcaatgttgcaccattaactttggcaattgtgcgtaaagtttttttcacatttcttcatttttcctctgcttgctagccatcttggtgattcaatcatatatttgttattaattaaaaatattgcaaatggcaatgaagaaactagaacaaaatcaaaccaatttctcaaccaccacatcaaaagaggcattgtgcaaattccaaacgtccacccaattccttgtaacatagcgacgtgtgagttttcatcacttgtcgatatttccattcctatgacaagaacagtctggtatagagacatctgcgggagtgcagtcaccacatattcaaatcntaccaataatat

SEQ ID NO: 1789 - DNA, 476 bp, Ctenocephalides felis
tgaaatgtgaagacgacgtcaacgaattgtttgacccaaaatctttctcgtgcagagctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatga

SEQ ID NO: 1790 - DNA, 428 bp, Ctenocephalides felis
  misc_feature (340)..(340): n = unknown
  misc_feature (387)..(387): n = unknown
  misc_feature (392)..(392): n = unknown
  misc_feature (415)..(415): n = unknown
tggtccccggccgaggaccgtcaagtccaatccaagagtggaaactttttcaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggccacatttntctatgcatcattaaataagggttttttacagcattcatttataatnggttnaagaattataatgattttatgangtttaaaaaaaaa

SEQ ID NO: 1791 - DNA, 492 bp, Ctenocephalides felis
  misc_feature (27)..(27): n = unknown
  misc_feature (205)..(205): n = unknown
  misc_feature (477)..(477): n = unknown
ggttcctttaagacagagtttggcttntattcattgaacagttcagaaatgcacagacttgtattgaatatgaaaaccagcgataaacttggaaaaaaatattttgaatacaaagttaaacgtgctgatcctgaattaaaaaaaggctgtgataaaacctgtcttaaaaatcatatgtgtgcaatagttaccacagttgtatcanatctcatccagtgcaaaaatatcatcaaatcatcatcaagcattcttcagcatttgaatatatatgtcctaggagctattgtaatttccaattatttattattataaagtcatttttgttaagttattataaatttagaataaatcattatgttggaaatatgtaaacgctttgaaaaagctaggatcaaatcaaatattttttgaaaaatcgaaaaaaaacaatttagtaaaaaaaacttatttgtaaagtgaaataaagatatctatatnttttaaaaaaaaaaa

SEQ ID NO: 1792 - DNA, 498 bp, Ctenocephalides felis
  misc_feature (28)..(28): n = unknown
  misc_feature (56)..(57): n = unknown
tgaaatgtgaagacgacgtcaacgaatngtttgacccaaaatctttctcgtgcagnnctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaaagctttatgaaattcatgtatctttttaata

SEQ ID NO: 1793 - DNA, 422 bp, Ctenocephalides felis
  misc_feature (22)..(22): n = unknown
  misc_feature (57)..(57): n = unknown
  misc_feature (77)..(77): n = unknown
  misc_feature (82)..(82): n = unknown
  misc_feature (84)..(84): n = unknown
  misc_feature (93)..(93): n = unknown
  misc_feature (112)..(112): n = unknown
  misc_feature (114)..(114): n = unknown
  misc_feature (140)..(140): n = unknown
  misc_feature (158)..(158): n = unknown
  misc_feature (380)..(380): n = unknown
ttctatatttatatattggggnataatcagaaattactatagctaatgacattttgnttgtgctccttacataaaanacaantntatacattntaatttttatacatatttntnatatttaattgcacagatcattccgngtatttattatattaatngactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcnatcggaaaaaacgttttcacttttgcatgcaattctgcacga

SEQ ID NO: 1794 - DNA, 498 bp, Ctenocephalides felis
  misc_feature (26)..(26): n = unknown
  misc_feature (407)..(407): n = unknown
  misc_feature (415)..(415): n = unknown
cacggaggatattggagaaagctccnttgaagaaggcaccacttccttctgtcttggcaatggtggcccagcagtgcagtgttcccttgtacaacatttcagactttgcacgtccagactgcatcatcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggtacaatccagggagaccatcagacttgaagattttggtcaagcagttgcccaatccagagaattcacgttgaccagcgccttttctnacataagnggccaatctggtacggcaaaatcaagtgggtagacgaagcacaatgatgtggcttcagcagcaccaccagatgccaagtttcc

SEQ ID NO: 1795 - DNA, 463 bp, Ctenocephalides felis
  misc_feature (58)..(58): n = unknown
  misc_feature (370)..(370): n = unknown
  misc_feature (424)..(424): n = unknown
  misc_feature (426)..(426): n = unknown
  misc_feature (428)..(428): n = unknown
  misc_feature (432)..(432): n = unknown
  misc_feature (435)..(435): n = unknown
agtatctcacaccgcctcttatttgcgtttgtgggccctgtcacttgctcacgcacanctttcagacgtattgtggaaaatggtgttgtccatgggattgagccaaacaacatatactggctcgattatgctctatgtgatattctgcgtgtgggcactattcacaattgccatcctagtcatgatggaaggcctttctgcgttcttgcacacactgcgtcttcactgggtggagttcatgagtaagttctactctggtttgggttatttgttccaacccttctgcttcaaaactattttggacgcggaggataaggaagcagaataatcaatttatctattatttaaataaattaaaaaaacaaattanttataaagaagttataaaaaagtaaattattggtaaaaattgattttcaaaggncngnaagntgnttttggaataagcacttaattttgtagt

SEQ ID NO: 1796 - DNA, 307 bp, Ctenocephalides felis
agcagtcaccttctttcgattgtgctttgttgcatagtcaaaagcgaatttggcaatcctttcagatttcttagctgttataatttttaaacattctacaactcctgtaacgctttcgtgctccaaagcactatactctccctcagtttgttcacgaatgattacacagtcaatattcttatgcctagagcgaactcctggcaaacttttaacatgaacaacattggcatataaatctagagtatttcttagcttcatgttgagcgtttgtagctcaccggtgtgagagtagtcaggtgtcgccagt

SEQ ID NO: 1797 - DNA, 474 bp, Ctenocephalides felis
  misc_feature (49)..(49): n = unknown
  misc_feature (51)..(51): n = unknown
  misc_feature (101)..(101): n = unknown
  misc_feature (170)..(170): n = unknown
  misc_feature (297)..(297): n = unknown
  misc_feature (379)..(379): n = unknown
  misc_feature (458)..(458): n = unknown
ttttttttttttttttttttttttttttaatttcataaagcttctatangnatatattttaaataatcagaaattactatagttaatgacattttgtttgngctccttacataaaatacaattttatacattttaatttttatacatattttttatatttaattgcacanatcatttgtgtatttattatattaattgactactttatgataatttgaatcctaattagtctattcaagattgttttcctggtttaagccttacttagcaatctcacttttgcattcttcgccgggnggcgtgggtatgcattgcaactccgttttatcaaagtgcaagccatttggacaatcataatgttttatttgccatttgttgntaaccaagaaacattgataatattttttacaatctcttcgatcggaaaaaacgttttacttttgcatgcagttctgcangaaaaaaaattttggg

SEQ ID NO: 1798 - DNA, 149 bp, Ctenocephalides felis
  misc_feature (33)..(33): n = unknown
  misc_feature (63)..(63): n = unknown
gcgctaaaggggaattcacttaaatctttaagntagtgtttgcaaactatcgatactatcganggtttcagacttttttctttcataaatacttttttgtgatatgaacatacttcgcaaaaattaaatttgacaaaaaaaatttaagt

SEQ ID NO: 1799 - DNA, 386 bp, Ctenocephalides felis
atatatcttacatcgaatctaataacattaaagagttattaattttcatgtcgatgttttagaaaatgattcagtagcaacttctgaattttctttgtaatcgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1800 - DNA, 459 bp, Ctenocephalides felis
  misc_feature (29)..(29): n = unknown
  misc_feature (363)..(363): n = unknown
gtttgacccaaaatctttctcgtgcaganctgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgnttttatgtaaggagcacaaacaaaatgtcattaactatagtaatttctgattatttaaaatatataaatatagaagctttatgaaatttaaaaaaa

SEQ ID NO: 1801 - DNA, 498 bp, Ctenocephalides felis
  misc_feature (59)..(59): n = unknown
aatttcacatcgaataatattattattcttacattctaccattccttggaatagttacncattcatttttagaaaaaaatataaatacaattccatttatcatttgcaaattttcaattttaaaaaaatattgattcgatacattttgtgatgtttacccgtattagccgaagggaatatttcgttggtttctgttgcggtaaaagaaaaatttgtagattatttaattttctataaatttgccgaatatttcattacaatcaaataaaccgttcaaaagttataaataaatgcacttttcctaaactcaagaacaaaacagtgaagcgctgtgaatatttatcaacttttcaacaaacttttttgagtataccgagttgctgtagggtcttcctatgttaggaaaatgttttagactattcaattttctatattttctccaaacatatttttagttttccgcaaataggttttaagttatcagaaatgtaacgaata

SEQ ID NO: 1802 - DNA, 221 bp, Ctenocephalides felis
  misc_feature (28)..(28): n = unknown
  misc_feature (31)..(31): n = unknown
  misc_feature (59)..(59): n = unknown
  misc_feature (202)..(202): n = unknown
ttaaatttaagtaaagtgcaaacaatanttnattatagactggcttacaataaacatgnaagctagtttacatattttaaatattttttatgtgaatgttataataatgagaccgtgttgcatgattattttctgaatactaaccattctccgatgtagaacgttactgtgataacttctgttagcggttacctgatgtatntgggttgcacttgagaagt

SEQ ID NO: 1803 - DNA, 167 bp, Ctenocephalides felis
  misc_feature (29)..(29): n = unknown
ctgcataccagtcagactgtttaggtgcntgtgtcacttcttccccatccataccatgcttaccatccttaccatctttcccaaccttgccaacatcttccccaacagcaggatttccttttggccgaaaatctcttgatatgcaaacaaaaactggaactaaatgt

SEQ ID NO: 1804 - DNA, 498 bp, Ctenocephalides felis
  misc_feature (177)..(177): n = unknown
  misc_feature (402)..(402): n = unknown
  misc_feature (469)..(469): n = unknown
catatgtagaaataccaatcaataagcagattttatcaaaaatatcaaatgttaaattgaacttttctttgaaaaatatcgatgaactaactattgatttgccacaaatcatatcgcaaacatttggaaatgtgcagaaaactgcaaatcttataccagaaaaagacgaaacaacantttcagataaacaacaaaattttgctaatgaagatttgtatgatccagagaagtttgaccaaatgccaggtccttggcccgttgacctaccattgcctatgccttgttggggaagagaaactgatgcaaagttagatttttcatcagtaatagaatatgaggcatttgccagcagagtagaaatgacggaacagagattattggaagagaccaactatgatctgnagataactttttacaattcaaccagggaatatagaaaaatgaaggatgcttccggacaaaatatganctgggataaatctttccggctttttcacc

SEQ ID NO: 1805 - DNA, 432 bp, Ctenocephalides felis
  misc_feature (60)..(60): n = unknown
  misc_feature (170)..(170): n = unknown
  misc_feature (177)..(177): n = unknown
  misc_feature (179)..(179): n = unknown
  misc_feature (268)..(268): n = unknown
tttttttttttttttttttttttttttttttttcataaagcttctatatttatatatggnaaataatcagaaattactatagttaatgacattttgtttgtgctccttacataaaatacaattttatacattttaatttttatacatattttttatatttaattgcacanatcattngngtatttattatattaattgactactttatgataatttgaatcctaattagtctattcaagattgttttcctggtttaagccttacttancaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctctttcgatcggaaaaaac

SEQ ID NO: 1806 - DNA, 414 bp, Ctenocephalides felis
  misc_feature (65)..(65): n = unknown
cacacaattagcaataggaaaatctagccacaaatttttttaacaatttatttaatacttatgtnctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaactaaataattttaatgttattaaaaattacatataaaataacttttacaataaagtaaccttacatgagatgtgttgatttcagatacttttcatacaacagtgctttctgtataaacaatataatataaataacggt

SEQ ID NO: 1807 - DNA, 382 bp, Ctenocephalides felis
  misc_feature (29)..(30): n = unknown
tgataaattgcctgcaagaatgagtttcnnggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagaaaaaaaaaaaaaaaaaaaaaaaaaaaaaaaaaaaaaaaaaaaaaaaaaaaaaaaaaaaa

SEQ ID NO: 1808 - DNA, 500 bp, Ctenocephalides felis
  misc_feature (51)..(51): n = unknown
  misc_feature (53)..(53): n = unknown
  misc_feature (142)..(142): n = unknown
  misc_feature (150)..(150): n = unknown
  misc_feature (188)..(188): n = unknown
  misc_feature (203)..(203): n = unknown
  misc_feature (211)..(211): n = unknown
  misc_feature (221)..(221): n = unknown
  misc_feature (319)..(319): n = unknown
  misc_feature (324)..(324): n = unknown
  misc_feature (335)..(335): n = unknown
  misc_feature (353)..(353): n = unknown
  misc_feature (364)..(364): n = unknown
  misc_feature (412)..(412): n = unknown
  misc_feature (449)..(449): n = unknown
  misc_feature (481)..(481): n = unknown
  misc_feature (494)..(494): n = unknown
ttttttttttttttttttttttttttttttttacaaaggaacggcccaaangntttatttttattaaaaagatacatgtaatttcataaagcttctatatttatatattttaaataatcagaaattactatagttaatgacnttttgttngtgctccttacataaaatacaattttatacattttaanttttatacatatttnttatattnaattgcacanatcatttgggtatttattatattaattgactactttatgataatttgaatcctaattagtctattcaagattgttttcctgggttaagccttacttancaatntcacttttgcnttcttcgccgggtggcgngggtatgcatngcaactcccgttttatcaaagtgcaagccatttggacaatcataatgnttttatttggcatttgttggtaaccaaaaaacattgnaaaatattttttacaaatctctttcgacgggnaaaaacgtttttncttttg

SEQ ID NO: 1809 - DNA, 500 bp, Ctenocephalides felis
  misc_feature (62)..(62): n = unknown
  misc_feature (207)..(207): n = unknown
  misc_feature (401)..(401): n = unknown
  misc_feature (408)..(408): n = unknown
  misc_feature (473)..(473): n = unknown
  misc_feature (490)..(490): n = unknown
tttttttttttttttgaacggcccaaacgatttatttttattaaaaagatacatgtaatggnataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttattttgccanttggtgntaaccaagaaacattgataatattttttacaatctcttcatcgggaaaaaacgtttttacttttngctgcattctggacganaaaaaatttg

SEQ ID NO: 1810 - DNA, 488 bp, Ctenocephalides felis
  misc_feature (483)..(483): n = unknown
tgaaatgtgaagacggcgtcaacgaatggtttgtcccaaaatctttctcgtgcagaactgcgtgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaatttaanaaaaa

SEQ ID NO: 1811 - DNA, 335 bp, Ctenocephalides felis
  misc_feature (33)..(34): n = unknown
tttctttaaaattgtaacatctatatacatganntcatgatcggctccctggtttatttctaccgattactacagtattatatttataatatgttcaatatagcactgtggtccaattttattttgaccaaaggtttatataaaaatccaggttttcttgatcatgtaaaatgttggtccattatcttaaattattatattcagaatgatatataatccattcaactttctaaaacaaacaagaaatctgtgcaacgtctgatatctgtgaatatgtattgtatttaatatatatgttaagtgtttaaaaatatatttctatttcatatacttgt

SEQ ID NO: 1812 - DNA, 415 bp, Ctenocephalides felis
  misc_feature (28)..(28): n = unknown
  misc_feature (59)..(59): n = unknown
  misc_feature (167)..(167): n = unknown
  misc_feature (385)..(385): n = unknown
cagttatttatattatattgtttatacnttaaagcactgttgtatgaaaagtatctganatcaacacatctcatgtaaggttactttattgtaaaagttattttatatgtaatttttaataacattaaaattattttgttctttctgttagatgaattgtgtgttanatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattgttaaaaatatttgnggctagattttcctattgctaattgtgtgt

SEQ ID NO: 1813 - DNA, 287 bp, Ctenocephalides felis
  misc_feature (26)..(26): n = unknown
  misc_feature (28)..(28): n = unknown
  misc_feature (56)..(57): n = unknown
tatcaagcaaactgaatttgatctgntntaaaactgaattcaagacataaaagcannaccaaatatgtatagataaaagataaagattgtaaaaagtttgagaaacactgtttggatggtgaaacgaaatatagaaaacacaaaagttaaaatatatatatactcagccccaaataatataatttaaaattatggttaagtttgtttagtagctcagtggtaatagcattagccttgcaaccagaattgcagattccattccctcattaaacctgatatcaagcagt

SEQ ID NO: 1814 - DNA, 287 bp, Ctenocephalides felis
  misc_feature (201)..(201): n = unknown
tatcaagcaatttgaatttgatctgaggtaaaactgaatgcaagacataaaagcatcaccaaatatgtatagataaaagataaagattgtaaaaagtttgagaaacactgtttggatggtgaaacgaaatatagaaaacacaaaagttaaaatatatatatactcagccccaaataatataatttaaaattatggttaagnttgtttagtagctcagtggtaatagcattagccttgcaaccagaattgcagattccattccctcattaaacctgatatcaagcagt

SEQ ID NO: 1815 - DNA, 126 bp, Ctenocephalides felis
  misc_feature (29)..(29): n = unknown
tttactacttcagaattatttatttctantaaacaacgaatttaaacttttagaatattcaaaattaattgcgacaagcaatattaccatgcactcttgaagattttaaaaaaaagtagttaaggt

SEQ ID NO: 1816 - DNA, 118 bp, Ctenocephalides felis
  misc_feature (27)..(27): n = unknown
  misc_feature (29)..(29): n = unknown
catcactgagaagaactcttcggctantnaatatcttcattggaggcgcgttgttggtgcacgcagcattaacaaggttcttgcaattcagcataatgaccagaagaaaaatacaggt

SEQ ID NO: 1817 - DNA, 500 bp, Ctenocephalides felis
  misc_feature (51)..(52): n = unknown
  misc_feature (397)..(397): n = unknown
ttttttttttttttttttttttttttgcacaaacaaatacatttattgttnntaagtgaagatttcatagaagaacatgtttaaaatagatagttgaaaacaagagtctaatgtaatacatagaagtagaaactggtgccttttgaataacttgtactagttttggcacaaagattaaaaatataaaataaattggaagccaatttatcgctattctattttttgtttaactataaggttatttaatagtaccctccaccccatttagtaaacagaattcagggatgatcgaattgcacttgaaaatacaaaaagatattttgcagtgaatggatatccctcgatattagcagtcaacaactgagaattaatgtcttttgttcaaattgttattcgntggctaataatatctcatattatacatctaacttaaatttatattaattaaactattttacatcattttagatgaactcggaataattttatatttaaagcaa

SEQ ID NO: 1818 - DNA, 500 bp, Ctenocephalides felis
  misc_feature (40)..(40): n = unknown
  misc_feature (63)..(63): n = unknown
  misc_feature (71)..(71): n = unknown
  misc_feature (88)..(88): n = unknown
  misc_feature (108)..(108): n = unknown
  misc_feature (128)..(128): n = unknown
  misc_feature (177)..(177): n = unknown
  misc_feature (184)..(184): n = unknown
  misc_feature (186)..(186): n = unknown
  misc_feature (204)..(204): n = unknown
  misc_feature (464)..(464): n = unknown
tttttttttttttttttttttttttttttttttttaattncataaagcttctatatttatggnttttaaanaatcagaaattactatngttaatgacattttgtttgngctccttacataaaatacanttttatacattttaatttttatacatattttttatatttaattgcacanatcattngngtatttattatattaatngactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgtcggaaaaaacgttttcacttttgcatgcagttctgcnagaaaaagattttgggtcaaaccattcgttgacgtc

SEQ ID NO: 1819 - DNA, 394 bp, Ctenocephalides felis
  misc_feature (29)..(29): n = unknown
  misc_feature (31)..(31): n = unknown
  misc_feature (59)..(59): n = unknown
tctccaatatcaaagcaggctacagacantnacaaggggatcacgagagctttcaagtnggtggatcaatatacgcaataactcataattcttctcattgagacgtggggcattctctctccagaacttagcagatttgtgaacaggtgaccattccaatctgccggacttgatttctgtagcatattcatcaaatgagccaaggtcttgaatggaagcttgtaatttttcggtcaaatattcaacatcagcaacgatatcctcatcatctgaacgtctttgttccaggatggataattgtttcaataccttgctttgcaccattgcaatgcaatgctccttggccacctgttgatcttccactttctcaattaaattcctataaacagccagt

SEQ ID NO: 1820 - DNA, 269 bp, Ctenocephalides felis
  misc_feature (28)..(28): n = unknown
  misc_feature (56)..(56): n = unknown
agatctactaatgccgcgtttaccactntcacagcaattccgcaaaccagcaaccncaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1821 - DNA, 496 bp, Ctenocephalides felis
  misc_feature (47)..(50): n = unknown
  misc_feature (175)..(175): n = unknown
  misc_feature (293)..(293): n = unknown
  misc_feature (325)..(325): n = unknown
  misc_feature (330)..(330): n = unknown
  misc_feature (411)..(411): n = unknown
  misc_feature (446)..(446): n = unknown
  misc_feature (483)..(483): n = unknown
  misc_feature (494)..(494): n = unknown
tttttttttttttttttttttttttatttcataaagcttctatattnnnntattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccgggnggcgtgggtatgcatcgcaactccgttttatnaaagngcaagccatttggacaatcataatgttttatttgccatttgttgttaaccaagaaacattgataatattttttacaatctntttgatcggaaaaaacgtttcacttttgcatgcanttctggacgaaaaaagaatttgggtcaaaccatttcntggccgtcgtntt

SEQ ID NO: 1822 - DNA, 296 bp, Ctenocephalides felis
catcaccgagaagaactcttcggctattgaatatcttcattggaggcgcgttgttggtgcacgcagcattaacaaggttcttgcaattcggcataatgaccagaagaaaaatacaggtactgcttttcattttgtttcagtaatagattacttcttgagatagataataatactgtggagaagtaaccttcacatgaagtaggcttggttctttataatcactggctttgttctggatattagaaatctgatcacaaaattttattaagttattattatgttaagtaacatcccac

SEQ ID NO: 1823 - DNA, 328 bp, Ctenocephalides felis
  misc_feature (29)..(29): n = unknown
  misc_feature (57)..(57): n = unknown
taaaatgttaaatatttataatatatttntgataaataagggtcattaaacatcatntgcatgtttttgaaaaaacaccacaacattgtttatagtaagctttgcctttgttactttagttttcaaaatttgttcaaggccctcttctccctttccttcgtaagcttttttaagtatctcataagtcaatcctttttttgacattttgcgaagtgtttcaatggttacgactgatttaagaggtgccaataatattagctcatcagccattttttgcatttccaaaatatcatcgataattctgagtttgtttgaaagttgcttcagt

SEQ ID NO: 1824 - DNA, 261 bp, Ctenocephalides felis
  misc_feature (35)..(35): n = unknown
tctcggtggaatcgatttctgtagtttcgtcgttnactgacaatattagagccaataaatatttcttagaaacatcaacagcccacgtagtctgtgcaagattggtagttggtatatccgtaatgataatctgaggttgttgctggtttaccgattgttgctggtttatcgattgttgctggtttagcaattgctgctgttgccagagaaatttttgttcctgaactttttggtattgtcgcaactgctgttgatgtaagt

SEQ ID NO: 1825 - DNA, 419 bp, Ctenocephalides felis
  misc_feature (29)..(29): n = unknown
ctgcataccagtcagactgtttaggtttnagtgtcacttcttccccatccataccatccttaccatccttaccatctttcccaaccttgccaacatcttccccaacagcaggatttccttttggccgaaaatctcttgatatgcaaacaaaaactggaactaaatgtacaaaaggagaagtttctaaagacgatttaaattctacatgtacctagtgagtgtgttatatgaaattgctattgcatattacatacaagcttaataaaggttaaaaaaaaaaaaaaaaaccttttgcatgtaggatccaatggatcgcgaaatagtccaactcttggacaaatgaatggttgctgccaaatacgaacgctgctggaatttgtttcaactggaattagttcttgagactccaaagacaatgt

SEQ ID NO: 1826 - DNA, 500 bp, Ctenocephalides felis
  misc_feature (61)..(61): n = unknown
ttttgttattttcggaaacttggattaatattgaagaacgaattaatattcagaactatgnctgcgttactcaatacaaacgatcggactcaagagcaggtggtgtagctgtctaatgtctattattcatgttcagatactcttcataatgcgactcctatgcagtttcttgcgccaacgatattactggatatttctaatgaaattacacaagtaggtgatattacacacacagaatcaaacattgattatagtcgtcctttacatttctcccaataaaaacatatcaaatattattaaatttcttcatcagcagttacttcatttttcttatgagggtgcaaaacttttaaacactaatcacaacgagataccattaattcttgctggagatttcaatgtcaattttccgttcagaagaatctcaaccattaattgattttttaaataataaatttaatttaacaatgaataattcttcatttgaatcaaccacaaga

SEQ ID NO: 1827 - DNA, 205 bp, Ctenocephalides felis
  misc_feature (29)..(29): n = unknown
  misc_feature (56)..(56): n = unknown
  misc_feature (148)..(148): n = unknown
ctgctaattatatacaaattatcaaattnaatgttaatgctaatacaactgataangttgagacaaaataaaggaagattcagataaaaatgtaaatattaatattaggcatttataacaaatcatgtgcttttccttgctcactaanatcttgctattatgttatggttgatactagacaactgtatattaagtaattataagt

SEQ ID NO: 1828 - DNA, 485 bp, Ctenocephalides felis
  misc_feature (59)..(59): n = unknown
  misc_feature (148)..(148): n = unknown
tcctcagcccggcacaaaagtaccccaatttgcccccttgacgggagatgacgtgctgngacctatgtcgccatcccggtcttcgctgaaggtaccttcccaaacatattccataataatccataatacataataattcacataatanttcgacggctgcggggttgattaagggcggtttccccgattgaaaccgtacgcgtccatcgattcggacatctcaatggtcctcgctcgtggactactgggcccagctttcaactcacatatataaccataaaacaaaaacgtaaatccgatatggcgtcccgatataagcctgcagacttatatttatacaatttatgttgcaacaacctactctccacaaacaaaaatcccactataacttcttatatgtcttcttaattttacgacttatctaatggggggaatcttaaaactaaacctattactataattatggttaattatttacatatgta

SEQ ID NO: 1829 - DNA, 173 bp, Ctenocephalides felis
  misc_feature (29)..(30): n = unknown
tttctttagtggtgcactgtagatatccnntttgatcagcgcacacttgatctgggctacaggattccttaaccggatctgctcctatttccggacaatactgcatttcgggtgaactgcacgaattcacgcaactaaattttacttttttacatttttgctcgggtttcggt

SEQ ID NO: 1830 - DNA, 493 bp, Ctenocephalides felis
  misc_feature (62)..(63): n = unknown
  misc_feature (205)..(205): n = unknown
  misc_feature (478)..(478): n = unknown
  misc_feature (487)..(487): n = unknown
ggttcctttaagacagagtttggcttaaattctttgaacagttcagaaatgcacagacttgnnttgaatatgaaaaccagcgataaacttggaaaaaaatattttgaatacaaagttaaacgtgctgatcctgaattaaaaaaaggctgtgataaaacctgtcttaaaaatcatatgtgtgcaatagttaccacagttgtatcanatctcatccagtgcaaaaatatcatcaaatcatcatcaagcattcttcagcatttgaatatatatgtcctaggagctattgtaatttccaattatttattattataaagtcatttttgttaagttattataaatttagaataaatcattatgttggaaatatgtaaacgctttgaaaaagctaggatcaaatcaaatattttttgaaaaatacgaaaaaaaacaatttagtaaaaaaaacttatttgtaaagtgaaataaagatatctatatnttttaaaanaaaaaa

SEQ ID NO: 1831 - DNA, 393 bp, Ctenocephalides felis
  misc_feature (33)..(33): n = unknown
tctccaatatcaaagcaggctacagacagaacntggggatcacgagagctttcaagtaagtggatcaatatacgcaataactcataattcttctcattgagacgtggggcattctctctccagaacttagcagatttgtgaacaggtgaccattccaatctgccggacttgatttctgtagcatattcatcaaatgagctaaggtcttgaatggaagcttgtaatttttcggtcaaatattcaacatcagcaacgatatcctcatcatctgaacgtctttgttccaggatggataattgtttcaataccttgctttgcaccattgcaatgcaatgctccttggccacctgttgatcttccactttctcaattaaattcctataaacagccagt

SEQ ID NO: 1832 - DNA, 322 bp, Ctenocephalides felis
  misc_feature (97)..(97): n = unknown
acttattaaacttttttcatcaattggaatgtctacagaacaccagcgtgttttataatgaatacaaaaacgcggaacagacaaaaataaatctaanttgcattattatgtttataatgtatcttagaacatcaaagatataaaacctttctaaatattaaattgaaaaaatatgaatagccatgatataagggtaaatagatgtccaaaaaaaacgtttcatttaagaaagtcatatgagtagattagattttaaatttgtgcacagaatttatgactcatgatctttttaatcgctattcataaaataaacggtaaaatg

SEQ ID NO: 1833 - DNA, 287 bp, Ctenocephalides felis
caaataatgatggatgtgatttcatatatccctaaactttggatcagagtttgagagaagcctagccatagtgtatagaaaattatgtgtaggtgtataattaagattgtcaggagtcaaatatataaagcattgatacaaattatacattccaattttctgtaaaccgtgttctttggttgattatggtttatatcacaatttatgaatcatgtaaattaattgtaaatttgaaatgtatctccgatgtaaatgtattaaaaaaaaaaaaaaaaaaaaaaaaaaaa

SEQ ID NO: 1834 - DNA, 313 bp, Ctenocephalides felis; identical to SEQ ID NO: 1334

SEQ ID NO: 1835 - DNA, 442 bp, Ctenocephalides felis
  misc_feature (438)..(438): n = unknown
caacacagagtttccacagttcagcaccattagcacaaacagacaaccggcatgagttatccaatcgcttgcgattctatgctctggtaaaaaatataagtcgagaagctgccatatgcttctccaaacattgacagttccaatgaaactaaaaaatagaaataagtcagcaactaaaactctccaaaatccttccaaacgagcacatgtccatcgcatgataggctgaagactgaatgtgagtattacaatcccgtagccaagtgcaagtgaagccagagcactaagcgatggatcatctggaaatataatattgtccaatatcacccaagctcccctccacacgacaaccaccaaggatccaacgatgaatacggaaaataagcaatcgattacgtaaagccatttcttctgatgactcgattctttaaaatatgnaggt

SEQ ID NO: 1836 - DNA, 167 bp, Ctenocephalides felis
ctgcataccagtcagactgtttaggtgcaagtgtcacttcttccccatccataccatccttaccatccttaccatctttcccaaccttgccaacatcttccccaacagcaggatttccttttggccgaaaatctcttgatatgcaaacaaaaactggaactaaatgt

SEQ ID NO: 1837 - DNA, 498 bp, Ctenocephalides felis
aaagatatagttttttaattgcaacatattggctataatcttgggttgttgaaaatcaacttggtttgagggataacaccactatagattcaaatactcgccaatcacacaaaaacacttttaaattccttctaccagaaaaaaaaatgacaaaaagaaaaacacgtttttaaccagttacagtagtgttactcctcaatccaatgaaattttatgcagttctgttacaaaattatatctgttgtaatatttaaaaaagttaaacttttgcttaaccaatgaaaataagatctcaatagaagacttaaattaaatatgatagtgatacatgagcatatgttcataaatcaactttctgattgattttctatgataaatgcattgactacactattttacttactactacacgtcctttacagaatgcatataaattaaaatatgcaatatatttatattcattgagtgaaaaccgatttgtaagcaaaacagcttaca

SEQ ID NO: 1838 - DNA, 498 bp, Ctenocephalides felis
  misc_feature (392)..(392): n = unknown
  misc_feature (397)..(397): n = unknown
  misc_feature (498)..(498): n = unknown
caataaatattgaatttacaggcttatgaacaccattaagagtaaacctcaatttgatcacagcacccttctctcccaactcaattttcttcgtataccccatgtaattgatatgattagccctttcctcttcctcgaaataaacccaattatgtagacctgttacttcacaattttttaattcagctaagaaaacatgctcaaatgctgaactaccgattttgccacctcctctggagtataaattaaaccaaatcgttttcaataaatccttatgagtttggggatctctagtcacaattcccttttcaataaaaaaattcataagatgtcgcatcaggctggtggataacattgcatctaacaaagcattttcttcatttctttcttgngcagntacatgttcatttactgcagtatctaattcataattattaaatatgggttcataagcgcttaggtttaatatcaaaagctgctgattcacaacaagccatn

SEQ ID NO: 1839 - DNA, 131 bp, Ctenocephalides felis; identical to SEQ ID NO: 515

SEQ ID NO: 1840 - DNA, 386 bp, Ctenocephalides felis; identical to SEQ ID NO: 468

SEQ ID NO: 1841 - DNA, 500 bp, Ctenocephalides felis
  misc_feature (63)..(63): n = unknown
  misc_feature (70)..(70): n = unknown
  misc_feature (470)..(470): n = unknown
  misc_feature (491)..(491): n = unknown
  misc_feature (494)..(494): n = unknown
ttttttttttttttttttttttttttcatatatcatataagttatatttcgtatacattttgnggtttgnggtccatattttaatttgctacttaacatattctatgattatggatttattcaaaattaatttatccaaacagcttataaaattgtatttatcttttatccattcaacaataaaatgttaacaaaaaaatacacatagaaatcttttcagacatggccatttaaacattttttcattaaggttatcaaaaatatatcaggcatggccatttatacattttttttattagagtcatcaaaaaaatagtataatttctatgttattattcaaaatctatacattaataaggatgttagaagtttgttcggttaattttcaggcagaggttgctattgtagtaatagaacaattttaatcatctaaaatttgattaatctattacatttaatcattcaatagnaaattccttttggaatttcgnaanggtggc

SEQ ID NO: 1842 - DNA, 494 bp, Ctenocephalides felis
  misc_feature (205)..(205): n = unknown
  misc_feature (458)..(458): n = unknown
ggttcctttaagacagagtttggcttaaattcattgaacagttcagaaatgcacagacttgtattgaatatgaaaaccagcgataaacttggaaaaaaatattttgaatacaaagttaaacgtgctgatcctgaattaaaaaaaggctgtgataaaacctgtcttaaaaatcatatgtgtgcaatagttaccacagttgtatcanatctcatccagtgcaaaaatatcatcaaatcatcatcaagcattcttcagcatttgaatatatatgtcctaggagctattgtaatttccaattatttattattataaagtcatttttgttaagttattataaatttagaataaatcattatgttggaaatatgtaaacgctttgaaaaagctaggatcaaatcaaatattttttgaaaaatacgaaaaaaaacaatttagtaaaaaaaacttatttgtaaagnggaaataaagatatctatatattttaaaaaaaaaaa

SEQ ID NO: 1843 - DNA, 500 bp, Ctenocephalides felis
  misc_feature (110)..(110): n = unknown
  misc_feature (477)..(477): n = unknown
ttttttttttttttttttttttttttttttctgacagactcgagctaggcttaaaaaactacatttttacagatgcgattaatgaaaattaaagtttgctactaatccanatctatccttgattctgtttttgctgctaatgtgccacaatgaaatttagatgctctcattttcttaaaactaagtgttaaatcatccattgtaattggtcgtagagcatcatgaaattcctcttctgcgtcttgtatgtgtggcaccaaaggtgattcagtgtgcatataatctctaactctatacacagaagcatttcggcataattcccttaagtctgatcctgaaaatccctcagtgagtttagataattcatctaaatcaacttcatctgaaataggttcattttctaaaataagctctagtatcttgaatctttgtgtcttatgggcatgccaatatggaatgtggctggcatacccgcanaattgctctatctaaatcttgag

SEQ ID NO: 1844 - DNA, 258 bp, Ctenocephalides felis
tttgttttactttatgtgttatataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaagatatagagttaatataaaaatgaagaaaataaaattaaaagtaaaaaaaaaaaaaaaaaaaaaaaaaaaaaaaa

SEQ ID NO: 1845 - DNA, 238 bp, Ctenocephalides felis
tttgttttactttatgtgttatataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaaagatatagagttaatataaaaatgaagaaaaaaaaaaaaaaaaaaaaaaaaaaaa

SEQ ID NO: 1846 - DNA, 456 bp, Ctenocephalides felis
ctttttgagaaaattaacacatttatacacttgatagaagaatttattattaatacatattatatatattgaatatagaaagcaaatctattataaaaatattaatgcacttatgtcaatagtttcatatagtattgccaggaaaagctaagtattaagtataatatatttagttattcttaaaacatatgttgttgttgttttgataaagctgtgtcttaaaatgactttatatacagcaattatcttcaataatcctttccacaattttgctcggtgtgttttagtttgctcaaatctatgggtgtattgttttccacatatgtcttaatttctttcatcaattccgatgatgggttttgctcacgtgtgagaatccaagctaattccatttttcctcgtggatgaattgtgcagctccacacaatagcaaatttatcaaaatcgctttttagt

SEQ ID NO: 1847 - DNA, 328 bp, Ctenocephalides felis
ctcttacccaaatattatctatatctcttacatatatagcatacaataatgggctaagtatacctccttgtggtagtcctttattcactactctttcaccaattattttgttatctttcttcactattatattcctttcatatatattaaatgttaaggctgacaccaatcggaatggtaatcctattttaattaattcttggaacattatacttggaacgacattatcatatgcccctttaatatcgcaaaagagtgccaccacataattatttcttgaaaatgccaaattaatatcaaccattaatttacataaattatccttcgt

SEQ ID NO: 1848 - DNA, 430 bp, Ctenocephalides felis
  misc_feature (96)..(96): n = unknown
  misc_feature (128)..(128): n = unknown
  misc_feature (135)..(135): n = unknown
  misc_feature (161)..(161): n = unknown
  misc_feature (197)..(197): n = unknown
  misc_feature (203)..(203): n = unknown
  misc_feature (213)..(213): n = unknown
  misc_feature (222)..(222): n = unknown
  misc_feature (255)..(255): n = unknown
  misc_feature (260)..(260): n = unknown
  misc_feature (267)..(267): n = unknown
  misc_feature (280)..(280): n = unknown
  misc_feature (320)..(320): n = unknown
  misc_feature (400)..(400): n = unknown
  misc_feature (405)..(405): n = unknown
aaattgttgatggcacaactttttgcagaaagttttgtaaactgattaacaaaaaaaggaaacattaccgataagtagaaaataatataactaacngtttgtaatatgctataaatcttaaaacaacnctcttgnaacaaaatattatagggagatattgnaggtgaaaccttaaagggtaaatagaaaagaaagcntttggntgaaaatgangaaatttgnttcaaaacttctgaacttttctagaaaccgtgnaaacntggctgnatttattggaaantattaatggaacctttggcggtttatttaccaaggttcanttcttcccggactatttttttttggcaaataaatttaaagattttatgatttttttggggacaacgtgcagtatttttgnatggntataaaataataaatctacacatgt

SEQ ID NO: 1849 - DNA, 416 bp, Ctenocephalides felis
  misc_feature (96)..(96): n = unknown
aatttatacaatattatatgtaaaaaggtattattgaaaatttatatagttgtctatggttttatgatgaaatgaaattttaacaaaaaataacanttttatataataacgggtataattaaaattgttattgtttaaaccatgacaatgaactttgagtgagaaattcttaataatgaatacgacaaatatgaattataaaatttcatttatgtatgtaaattaaaaatttttattacttttgctatttataattcatttaagttgggagattaggtgtccagctaaattgaatggaaaagcaaatttaaataatacctgtatcgaaaagagattataaagatgtaattataattacaacaattcaaaaattgttataaaagatttagaaaatgtcaaaaaattgattcatgagt

SEQ ID NO: 1850 - DNA, 282 bp, Ctenocephalides felis
atttatatacaagaaaatagaacaagcaatatacgagctttcaaattatacatatttacataaaattacattgggaacacgacataccgcgttacacaggagtattatattttattggggttcataatgtagttattttttacgtttatttgttcttttatttctttggattaaaaaaataagcatacaggacatttttgtgtataaaatatatatgaaaaacaaattgtttttttaaagcttacaaaatcataaaagaaaagatctatgtaatataaaagt

SEQ ID NO: 1851 - DNA, 472 bp, Ctenocephalides felis
cggtttgggtgatacaacaccaaagacacgctcagaattgacgttaccattaggtaattccaggttcacgagagtcaaatcatcaaaggggtagcgttctttaaagcgtttatccaaagagtcccaagtattatccaattcctcatccacaaccaaaggatatgcattcttcgaatccaaactaagtttatcagtgccttctacaactacagtgactacagctttaggtaattgaaaaggattcaatttactcactccgtcccattcagcagaactctgctccgatgtcaatcctaaggctacggaatacaattcctttaacaaagattggggtaaaggagtctcgccttggaattggactccatttggagaatttaatacactcagttcgccgttgcaatatatggatgccacaaggggcagtaaataaattagaaccttttgccacattttattacttacggataaacgt

SEQ ID NO: 1852 - DNA, 118 bp, Ctenocephalides felis
ctgtatttttcttctggtcattatgctgaattgcaagaaccttgttaatgctgcgtgcaccaacaacgcgcctccaatgaagatattccgtagccgaagagttcttctcagtgatggt

SEQ ID NO: 1853 - DNA, 500 bp, Ctenocephalides felis
  misc_feature (450)..(450): n = unknown
tttttttttttttttaagctttccaacatttgtattttattcaaataaatataaataaaaatcataattcgacaattttacttgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatacatattcataaatatacatatattttaatacaaaaaggtaacttgngcaaaaatgaaattcaaatacacttggtttgctaatttaaattggtttag

SEQ ID NO: 1854 - DNA, 386 bp, Ctenocephalides felis; identical to SEQ ID NO: 498

SEQ ID NO: 1855 - DNA, 386 bp, Ctenocephalides felis; identical to SEQ ID NO: 354

SEQ ID NO: 1856 - DNA, 270 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataataagcacctattatgggaaatccaatcgcatatccagcttccaacattaaagaatgcataaatgcccgttcttccattgtgtctttacactcggtcgt

SEQ ID NO: 1857 - DNA, 176 bp, Ctenocephalides felis
aaccaactagagctaagaaaaaagccagcgatagcatagaactgctatgttcccctccaaataccactgttgttttatcatataaaaatgccataagtatggagctaatgcatccaatcaccatcaatatatatatatatgaagagtcttttatccttcctgggtaaagtttctgt

SEQ ID NO: 1858 - DNA, 244 bp, Ctenocephalides felis
aattctgtgtagatgaacatccaagaccacaaacaactctagaaagtttatccaaattacctacaattttcaagaaagatggcgttgtcacagctggatctgcttccggaatatcggatggagcagcagcgattgttttagcatcagaagaatcctgcaaacagtatggcttaaaacctttggcaagattggttggatactctacagttggtgttgaacctagcataatgggtatcggacccgt

SEQ ID NO: 1859 - DNA, 287 bp, Ctenocephalides felis; identical to SEQ ID NO: 1833

SEQ ID NO: 1860 - DNA, 498 bp, Ctenocephalides felis
tttaaataatttataaattaatttttgtttcacctttagggcagtggtttccaaccctttggcactcccataatcataattttctggcagtaactttttttttcttgttttttggtttgtttcgcaacccacaggttggaaactcctttttagtttaacagtggtttccaatcttcctacaccgcggtccctcatttttaaatttttgcgttttaatttttttttttaatttctccagcaatatgattttataaattttcaactgatatatattgtttaaaaaaaaatattaatagaaaaaatgctaatttttataaaatgtttttattttgtaaaaattggcattctttctatcaatattttttcttgtatcttcaatcttatatttttatatatttctttttttggtttgtattcaaaaatagtattttggaaacagtttcagccttctgaaaactgccttgcgcgcaccacagattgaaaaacactgatttagac

SEQ ID NO: 1861 - DNA, 500 bp, Ctenocephalides felis
ttttttttttttccggtccatacaactctaagctttccaacatttgtattttattcaaataaatataaataaaaatcataattcgacaattttactcgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattattctataacgaatttaacctaaaatacaagaaatacatattcataaatatacatatattttaatacaaaaaggtaacttgtgcaaaaatgaaattcaaatacacttggtttgctaat

SEQ ID NO: 1862 - DNA, 500 bp, Ctenocephalides felis
  misc_feature (174)..(174): n = unknown
  misc_feature (183)..(183): n = unknown
  misc_feature (380)..(380): n = unknown
ttttttttttttttttttttttttttttttttaatttcataaagcttctatatttatatattttaaataatcagaaattactatagttaatgacattttgtttgtgctccttacataaaatacaattttatacattttaatttttatacatattttttatatttaattgcacanatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgntgttaaccaagaaacattgataatattttttacaatctcttcgatcggaaaaaacgttttcacttttgcatgcagttctgcacgagaaagatttgggcaaaccattcgtgacgtcgctta

SEQ ID NO: 1863 - DNA, 403 bp, Ctenocephalides felis
  misc_feature (373)..(373): n = unknown
  misc_feature (376)..(376): n = unknown
caaatatctagcatgccaacattcgtgttcctgaaaaacggaaccaccgtaaccacgttcactggtgcgaactacgacaaagttcgggaaaccattacttctaatttataaatctttatgctgagtgcctgctatagatgtttaggcttagatttcaaaattttaatgtttcagaaaattgttcatgtttgcacaaattatatgtatatattttttcttaacttcaaatcctaaaattacttcattgtgctattttattcattaagcgtattctacatagatcacatagtgtctttatcagtgagcagttcatagtatatttaagctaatatattttttgttactgtatgagttcataaaggttataacacanaanaaaaaaaaaaaaaaaaaaaaaaaaaaa

SEQ ID NO: 1864 - DNA, 488 bp, Ctenocephalides felis
tgcactgacacattatttagaaattactgcaattccgagaactcatgtcttaaaagaacttgctgaatactgctctgatgaaaaaaaaaaagaacaattaaaattaatgagctcaactgctccagaaggaaaacaattgtatcaagattgggttgttgaccagaaccgtaatattgtgcatattttggaagatctgccatcatgtcgtcctccaattgatcatctgtgtgaattgttacctcgcttacaaccacgttattactcaatttcaagtagtgctaagctgtttcctaccacagttcatatcactgctgttctagtgaagtataaaactccaactggtagaatcaacaaaggtgttgcaacatcttggctggccaaggtcaaccccagtcctgagaaacctcaagttgtgcctatatttattagaaaaagtcaattcagactgccaaccaggtctcagactcaattattatggttggtcctgg

SEQ ID NO: 1865 - DNA, 498 bp, Ctenocephalides felis
catctattaattccagtatggtgcttacttgcaacaacatcctggataggaagtcttctgattcaacctccgcgtctaaattcataagtccactttttccatctttaggattagttaaattcgataacaagatttttaaaaacatctgtaattcaagtaaatcactaataaaaaaatctctatgtgctggctcgtcaagaatacttaaggcttcaaacccaacagcaaccgaagattggtcaatttcattagcatcatctccagcaataagatcaatcttgaactccttttcttctattttatcattaaaatatgcaaacataatttcttcttcagtttgactatcatcaaatccacttcatagggcagcttatctaaaacaacacgcttcggttccttgcagtgtatgaattgataaacggcgtgttaccaaattcaagaatatgtctaacaacgtctagtcctacctttacatttcttttatttttgaatctttta

SEQ ID NO: 1866 - DNA, 500 bp, Ctenocephalides felis
  misc_feature (66)..(66): n = unknown
  misc_feature (157)..(157): n = unknown
  misc_feature (205)..(205): n = unknown
  misc_feature (325)..(325): n = unknown
tttttttttttttttttttttttttttttcatatatcatataagttatatttcgtatacattttgnggtttggggtccatattttaatttgctacttaacatattctatgattatggatttattcaaaattaatttatccaaacagcttataaaatngtatttatcttttatccattcaacaataaaagtgttaacaaaaaaatncacatagaaatcttttcagacatggccatttaaacattttttcattaaggttatcaaaaatatatcaggcatggccatttatacattttttttattagagtcatcaaaaaaatagtatantttctatgttattattcaaaatctatacattaataaggatgttagaagtttgttcggttaattttcaggcagaggttgctattgtagtaatagaacaattttaatcatctaaaatttgattaatctattacatttaatcattcaatagtaaatttccttttggaatttcgaatgg

SEQ ID NO: 1867 - DNA, 230 bp, Ctenocephalides felis
  misc_feature (182)..(182): n = unknown
tattctgaactaaacattgttaattcaaatctcaattctaaattaaatctttcatggaatcttgcttgaaaattgaaaattactctccattattttacatgcgataatttattttgttgtagatcaaagatataagaattagtgataaatttaaagaaataagagaacaataaacatattgntaaaatcatcatttttatagtaaatgatagatttatgacaacgtctgt

SEQ ID NO: 1868 - DNA, 493 bp, Ctenocephalides felis
tttttttttttttttaatttcataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgacgagaaagattttgggtcaaaccattcgttgacgcgcttcacatttcag

SEQ ID NO: 1869 - DNA, 296 bp, Ctenocephalides felis
catcaccgagaagaactcttcggctacggaatatcttcattggaggcgcgttgttggtgcacgcagcattaacaaggttcttgcaattcagcataatgaccagaagaaaaatacaggtactgcttttcattttgtttcagtaatagattacttcttgagatagataataatactgtggagaagtaaccttcacatgaagtaggcttggttctttataatcactggctttgttctggatattagaaatctgatcacaaaattttattaagttattattatgttaagtaacatcccac

SEQ ID NO: 1870 - DNA, 425 bp, Ctenocephalides felis
agacgttgtcataaatctatcatttactataaaaacgatgttacgtgcatcgaagacgcaactcttatttcattaaataaaatcacaaacataaatattttaaatacatatatacaagtaaaacatttcttggtctaaataatgccatatactttatgataatattttatattaaaatgtttcattatcaaattactaatcacttacggatgtcaataaacaaatctaaaatgatgatttaacaatatgtttattgttctcttatttctttaaatttatcactaattcttatatctttgatctacaacaaaataaattatcgcatgtaaaataatggagagtaattttcaattttcaagcaagattccatgaaagatttaatttagaattgagatttgaattaacaatgtttagttcagaatagt

SEQ ID NO: 1871 - DNA, 369 bp, Ctenocephalides felis
cagtgatcaacaaaatgatattgtcaatcatataactgtaggttatgaaatccaagaaagtggacagaggttcgacagcatggtttctcatgtgttggaattcaataaccaatttttcacgtaatttgtcatcaatggtagacacagataagggggaaggctcatttgataaaaaggtgccataatctgtaactgccaggtgcagcttcaaatcttcaagagtttcacattgcacaagatttaaataatcggattgtttaagaattccgcacttgaaaccacggcacaggccttccagatagccaccatcaatattaaacatgaaacccatttttattcaatttatctggcagtaatcgtctcgtatta

SEQ ID NO: 1872 - DNA, 392 bp, Ctenocephalides felis
aaacctatttaagcatcttaaaaataattaattacaacaattacactaaattaaattagaattaaatcttaaactaacaaattcacttccacgtgtatgtcaaaaataaaatcactcacaaatctttaagcaaacaccatgacaagttcactcttgatgacaaagttcttatcttttatttacaattgtctttgcacaataatggattatttaaattaaatcactttgattgatttatgtgatgttcttcatctgatattttggatcttcgtcgtccaatttggtcaaaacttgcatttttgaattggccttctcgaaggtgtcgtattctgctgatttttgctctggagcccaccttctaacttgtggtgccaacagcattttatccaggt

SEQ ID NO: 1873 - DNA, 261 bp, Ctenocephalides felis
aaaaaaactaaaaatagcaacttttgaagaaaagccaataaatctttcgctgaaacaagttgatacatgcgattttcaaaaaaaaaaaaaaatcaaaaggaactgcatcttgaaagtgtttttagaattatatatttctttaggattctataaagttaagaatgcctgtacaggcatattttagcacaatttttatcatgatgataattattttctatatttcacatattggcaaagcaaaaaaaaaaaaaaaaaaaaaaa

SEQ ID NO: 1874 - DNA, 270 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatggggaaatccaatcgcatatccagcttccaacattaaagaatgcataaatgcctgttcttccattgtgtctttacactcggtcgt

SEQ ID NO: 1875 - DNA, 498 bp, Ctenocephalides felis
aatttcacatcgaataatattattattcttacattctaccattccttggaatagttacacattcatttttagaaaaaaatataaatacaattccatttatcatttgcaaattttcaattttaaaaaaatattgattcgatacattttgtgatgtttacccgtattagccgaagggaatattttgttggtttctgttgcggtaaaagaaaaatttgtagattatttaattttctataaatttgccgaatatttcatttcaatcaaataaaccgttcaaaagttataaataaatgcacttttcctaaactcaagaacaaaacagtgaagcgctgtgaatatttatcaacttttcaacaaacttttttgagtataccgagttgctgtagggtcttcctatgttaggaaaatgttttagactattcaattttctatattttctccaaacatatttttagttttccgcaaatagtttttaagttatcagaaatgtaacgaata

SEQ ID NO: 1876 - DNA, 386 bp, Ctenocephalides felis
atatatcttacatcgaatctaataacaataaagagttattaattttcatgtcgatgttttagaaaatgattcagtagcaacttctgaattttctttgtaattgataatactttctcaaaatataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1877 - DNA, 206 bp, Ctenocephalides felis
cggcgcagtttactacggtccgtgcaatagaccatcaagtgactgctttaattccgaatgataaaaattaattaagattaaaagtatttacatacattaaacgcaaaaattaaatctcatctcctcttttatgtgcagtttacttgattgtcgttcggaaaaaaaatcaaagttcgtcgagcgcgtgggtgactaatgtctgttgt

SEQ ID NO: 1878 - DNA, 406 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgtactattcgtagtatcaatgaagtcgtccgccctaagcattgatgaattttggacaacgtagcatattgtacttggtactcctggatgagcgttttgaaattctgtcattttacttatgatatcgggaaaccacatgt

SEQ ID NO: 1879 - DNA, 498 bp, Ctenocephalides felis
aattttattgtatttatatacagataaaaattgatatcaagttagataacaaaatataaaatttaaaaatcaaaacatatttataaatttttttggtcttatttctagaatttattcagcattagaaacattttgaataattttcttgaatattgtgatacctcgaaggaaagtttctgtatctaaatattcatcatggtcatgcagcaatactggcgtgttattcatgggagaaaaaccaaaagccggcagtccaatttctcttatatatctgctatctgttgcagctggaaaaacttgtggttcaagaacaagtcccatttcatcagtagctcttttaaatgctgtccaaaatttattgctttcattcagttcagtgtttgctatcagtggttctttttgtcaaattctatttcaacatccttgccagcttctttgcaccattttcgtatcttttcttccaattccttgtggctaaggatggtgtaatacgtatat

SEQ ID NO: 1880 - DNA, 353 bp, Ctenocephalides felis
  misc_feature (324)..(325): n = unknown
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttaaatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcnngcaaaaaaaaaaaaaaaaaaaaaaaaaa

SEQ ID NO: 1881 - DNA, 242 bp, Ctenocephalides felis
taaaataaagttacaaaggatttctcaaggtctggtgagacgttccacaaaaattctagaaatcagaacaatgcttccaaaatacaaatacacgtcctacaatatcaccattcaacacctccaacaattttactatatcatttactcctcaaaattcgtcctagtaggcttataaacaccgacatccttgtcctccgaatggtagcccaaggaggccaattcgtccataacctcaacattgt

SEQ ID NO: 1882 - DNA, 413 bp, Ctenocephalides felis
  misc_feature (165)..(165): n = unknown
cgttatttatattatattgtttatacagaaagcactgttgtatgaaaagtatctgaaatcaacacatctcatgtaaggttactttattgtaaaagttattttatatgtaatttttaataacattaaaattatttagttctttctgttagatgaattgtgtgttanatcttgtgctgtgatttacatacaatttaatacagattgaaatgcaatctataaaagcattatttcaataatcattatatagtaattttgattttgactatttgcagataaattcattacattttaaaatgtttactttattaagctatacaaaccttgaactttacactttgtatttctagaacataagtattaaataaattgttaaaaatatttgtggctagattttcctattgctaattgtgtgt

SEQ ID NO: 1883 - DNA, 443 bp, Ctenocephalides felis
  misc_feature (197)..(197): n = unknown
  misc_feature (269)..(269): n = unknown
  misc_feature (363)..(363): n = unknown
gtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaatatattaaatttacaatagngttttaaatttgacacacatttatctatgcatccataaataaaggttatctactgcattcatttacaattgnttatgaattattatgattttatgaaattttgtacatattccaacatcaatggccatgttagaatttgggcatgctatttttttaatcagataanttatgatgaacctagaactatagctatgcttctgatgaaagtctaatgaataatttataataaaattcagaaatcgaaaa

SEQ ID NO: 1884 - DNA, 251 bp, Ctenocephalides felis; identical to SEQ ID NO: 1001

SEQ ID NO: 1885 - DNA, 498 bp, Ctenocephalides felis
ggatatctggcgtcatatgtggttcccaagtatacaatgtatgggcctaatactcctaatgtatttgaaactatagttccaatggaaattcctgtctgcctcaaacaggttggatatgtttccattgcttgcagattcacaacataaaacgtgatgcttatgcaaaatttcattaccacggctaacagtgggaccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatggattccgta

SEQ ID NO: 1886 - DNA, 500 bp, Ctenocephalides felis
  misc_feature (55)..(56): n = unknown
  misc_feature (97)..(97): n = unknown
  misc_feature (175)..(175): n = unknown
  misc_feature (212)..(212): n = unknown
  misc_feature (450)..(450): n = unknown
tttttttttttttttttttttttcaatttcataaagcttctatatttatatattnnaaataatcagaaattactatagttaatgacattttgtttgngctccttacataaaatacaattttatacattttaatttttatacatattttttatatttaattgcacagatcatttgngtatttattatattaattgactactttatgataattngaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttntgcacgagaaagattttgggtcaaaccattcgttgcgtcgtcttcacatt

SEQ ID NO: 1887 - DNA, 269 bp, Ctenocephalides felis; identical to SEQ ID NO: 441

SEQ ID NO: 1888 - DNA, 498 bp, Ctenocephalides felis
aaccacgagcattcctattgttaatgtcgtgactgacgtagcatcgatcttcgtttatcttgcagactgccactttagctgccaattccgcagcagtgttgcttgtgcaggtgtcatcattttcgttgcattttacacatttcaggggatcatttttattacataggttactattgcactttagacaagacccagatgttgcattttcgcattcttttctaatcgaatcagtttcaggtaaatcgaccaaacaacctttttttgtttcagtgccgttaacatagatgtaacacaatccttcacattttttttctcctccgtcatccgttgcacatgacgggcgctcgaaatccttattattgcatgtagcaccgacacaagttttgcaaagagtattgccatcgcagatatccttcgttgcgcaccctcgattaactttacctttttctagtttagcgtagcataattctccattacatatgctaacaatcttgcctt

SEQ ID NO: 1889 - DNA, 500 bp, Ctenocephalides felis
  misc_feature (54)..(55): n = unknown
  misc_feature (72)..(72): n = unknown
  misc_feature (76)..(76): n = unknown
ttcctttttttttttttttttttttttttttaacggcccaaacgatttattttnnttaaaaagatacatgtnattncataaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcacgccagtctgc

SEQ ID NO: 1890 - DNA, 331 bp, Ctenocephalides felis
  misc_feature (85)..(85): n = unknown
  misc_feature (88)..(88): n = unknown
  misc_feature (93)..(94): n = unknown
  misc_feature (101)..(101): n = unknown
  misc_feature (109)..(109): n = unknown
  misc_feature (112)..(112): n = unknown
  misc_feature (124)..(124): n = unknown
  misc_feature (190)..(190): n = unknown
  misc_feature (308)..(308): n = unknown
  misc_feature (321)..(321): n = unknown
tttttttttttttttttttttttttttgatttatttataaataactttaggggtccgccactaggggacttccccctacatttanaantccgnnttatttnttactttnaantttattttcttnatttttatattaactctatatctttatctatctatctattacttcaaccaataaaattaagcgtanaatgaataattttgattagaacaaatatattcatggatttaaaaaaatctaaattgtaaaattcttaaatgccttatcatatttgcgagcctgtgttcaaccataatatttttttatntaacacataaagnaaaacaaagt

SEQ ID NO: 1891 - DNA, 393 bp, Ctenocephalides felis
tggctgtttataggaatttaattgagaaagtggaagatcaacaggtggccaaggagcattgcattgcaatggtgcaaagcaaggtattgaaacaattatccatcctggaacaaagacgttcagatgatgaggatatcgttgctgatgttgaatatttgaccgaaaaattacaagcttccattcaagaccttagctcatttgatgaatatgctacagaaatcaagtccggcagattggaatggtcacctgttcacaaatctgctaagttctggagagagaatgccccacgtctcaatgagaagaattatgagttattgcgtatattgatccacttacttgaaagctctcgtgatccccttgttctgtctgtagcctgctttgatattggagagt

SEQ ID NO: 1892 - DNA, 492 bp, Ctenocephalides felis
  misc_feature (62)..(62): n = unknown
  misc_feature (481)..(481): n = unknown
  misc_feature (483)..(483): n = unknown
tgaaatgtgaagacgacgtcaacgaatggtttgacccaaaatctttctcgtgcagaactgcntgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattnanaaaaaaaaa

SEQ ID NO: 1893 - DNA, 500 bp, Ctenocephalides felis
  misc_feature (2)..(2): n = unknown
  misc_feature (19)..(19): n = unknown
  misc_feature (87)..(87): n = unknown
  misc_feature (247)..(247): n = unknown
  misc_feature (497)..(497): n = unknown
tnttctttttttttttttntttttttttttatcatttttaatttatttcatcaactacattgaaattaaacaaataaagaactattnttcttaaattaaagggaaattttacatcatacattcaacatgaatcaattctaaaattatgtgaataaccaaaattttaaaccattaacacaaatattttttattcccacttaacttattacttattaaaatattacttggcaagtatttttatattttnggatttttttaggtatattataaagacgcctttagttgttgccttatgaataaaatacatatttataatacattcacatattatatactaaactattgagaagacttagacgatttaatggaattaatatgaaggaatttattaatttaaattttataaatataaaaaattttagggctttttttaagatatcctatgttatattataattcgttttcatttacagatgtggcatataggtatatttttngtt

SEQ ID NO: 1894 - DNA, 473 bp, Ctenocephalides felis
  misc_feature (383)..(383): n = unknown
aaagcttctatatttatatattttaaataatcagaaattactatagttaatgacattttgtttgtgctccttacataaaatacaattttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcnatcggaaaaaacgttttcacttttgcatgcagttctgcacgagaaagattttgggtcaaaccattcgttgacgtcgtcttcacatttcag

SEQ ID NO: 1895 - DNA, 302 bp, Ctenocephalides felis
taaatgatgttatagtctaaacagaagattagtactaaaaaaaggccaaacattaaaatggaataaaagccataaaaatcacttcctttgcacatctagtcacacactttgatccgaaagttgcccgaatcgtcagaatttatgaattttattataaattcacaatgatcgcatcacataaaattgtctttaaatctgtttatcttgcaggaaaaatatcgcaaacacgtttttttctggcttctaactcaatatttaacacacgtaaattatcacaccgttgggcaagctgatggcctggt

SEQ ID NO: 1896 - DNA, 399 bp, Ctenocephalides felis
atcgagaatatacccatgaggagaatgatatagcgaccggagaaaaagatgttccaaatttcactgttgatttttttggcacccaaactcttttctctaactaccatgaacagaccgaataacatcataattataccgtggccaatatctccaaacataatgccgaacaaaaatggaaaagtaatgatggtgtacagagctggatttacttctctgtaactagcaactccgtaggcatctatcaagttttggaaaccttgagtgaatttgttagttctattaaaggttggaggtgcttcttcagtttcaataacatttaggaaggattcgattgaacttccacacgcgttcgatccatcagttaaggctttttgaacaagttgtagatcattaactggt

SEQ ID NO: 1897 - DNA, 339 bp, Ctenocephalides felis
cattctagagtatttggggaaagaagattgttcgataaatcaacaattttagacaaacgagaaattaagtaatattataaaaatagatatcaatctttcatcttactaatttgatattgataaaaaacgaagcaatacatagggtgtgtggttgaggcgtttctttttttgttttatagtagatgaattctaaaacatccagaaaaataatatatataaatcagttaaaaaaatgttttttttcgcctattcagtatcacaatatcccaacaatgcaatatatggttggcacccattcaaaactaaagtatgacaagacgcatagccaattgaaaatgt

SEQ ID NO: 1898 - DNA, 500 bp, Ctenocephalides felis
  misc_feature (59)..(59): n = unknown
  misc_feature (77)..(77): n = unknown
  misc_feature (164)..(164): n = unknown
  misc_feature (380)..(380): n = unknown
  misc_feature (435)..(435): n = unknown
  misc_feature (437)..(437): n = unknown
tttttttttttttttttttttttttcgtttaaaatactttatttaataattattacagntcagtttacatgcaggtncatttacagtacatttttttataaataaacgtgatttgcctagcagtcttataaaatacagttcaacaattccttatacttatcagngctttctaaaataacatacataatttaaatcaaaattaaatacgagtaacaaaagtagtaaacaaatagaattagttctaatttacttatacctaaactaattcagataagttgagtagatcgccattttcttttaatttaataaaaaaaattatgatgtattaaatatttcacatattgtttttaaatgtttcagatatcttatacaagtttgtncactattattacaaagatttcgcttgtatgaatgaaatttttttaatcaatattngngtatcatttttgcaataaaaacatacgagttgccagtaaccagtaaatgtaatggcacacaaa

SEQ ID NO: 1899 - DNA, 340 bp, Ctenocephalides felis
  misc_feature (223)..(223): n = unknown
tttttttttttttttttttttaattacaaaggaacggcccaaacgatttatttttattaaaaagatacatgtaatttcataaagcttctatatttatatattttaaataatcagaaattactatagttaatgacattttgtttgtgctccttacataaaatacaattttatacattttaatttttatacatattttttatatttaattgcacagatcatttgngtatttattatattaattgactactttatgataatttgaatcctaattagtctattcaagattgttttcctggtttaagccttacttagcaatctcacttttgcattcttcgccggg

SEQ ID NO: 1900 - DNA, 498 bp, Ctenocephalides felis
tttgtttttcttttaattgatgcttgctcatagaataatgtaaattccgggcaatctgtagcggaaaccaggaaatataatccagctaaaacttgacctttggtatcacgtgccagtaatgaacggaagttgtatactaaattacgccttactgtcacatccactgcagtataataaggtttatgcacatatactagagataccactagatttgtagttgttcctccttctttaatagttctgtgttgtcgttcatgccattcaacataatgagaagattgagtgctataagcatagcaatattcgcgtttgcttccacctggcccttcatcacattgtgtaaaccaacccgtatgtggatatttttcatcagccattactgtcactactcttgcgacgtgatatcctggatcacaaaggactacaccttttcttccatttatgcaaatacgaatagcaaccataacgtgttctttttctaaggcgccgcctggagcc

SEQ ID NO: 1901 - DNA, 386 bp, Ctenocephalides felis; identical to SEQ ID NO: 498

SEQ ID NO: 1902 - DNA, 331 bp, Ctenocephalides felis
aaataatactacttacaagttaacctatcacgattattatataatttttttgtaaattacaagttctttactcgatgtcacctcactgtacatatgaaacaaagatgtgacgctctttataaatttatcactaccttatctataatcatatcacctcacataaatttcataccatggttgtatttacaaaattcagacagtagttgacagagatgtattcgaaatttgaatcattaaacaaaaatattttgataaaattgatatgtctctccttaaaaaaaattgaatttctcatttataattatttcttgttctgggcatatgtaatagt

SEQ ID NO: 1903 - DNA, 327 bp, Ctenocephalides felis
tacttcatgtattaagcattttgtatgaatattatgtagtcgatgtgtctctaatatattactgttgagcaacatatttttatagataagagtagatgtaataattcattttaagaattgagttactagaattattctattatgctgtattatatgttaatataactatattaaaagaaaaattattaatattaatgcatcttttaataaactgaaaagaacagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1904 - DNA, 466 bp, Ctenocephalides felis
cactcgtgttcttttcccatcttcattttgactgcccaacataagtataatgtctttatcccctagattgctgcttgaaacaacaactgtatgcacatgacggctatgaaaccattctgtgcatttccatgcatcgtcaatgttatgaattttgcaaccagtgagcaactccacctcaaattgatttggagtaacaatatcagccaatggaataattaattctctataaattggtaataatgattctggaacatacatttttccattatcacctaacactggatcgcaaacgtatgtcaattttggatttttttctctcaattccttaacgacgtttgcaattgttttaagaaaatctggattagctacataacccgttaataaatgactgtagacattgataccattcaatgctaacccttctgccagctctcctaattccttgtccgttagaacttgccctcgt

SEQ ID NO: 1905 - DNA, 498 bp, Ctenocephalides felis
aaagatatagttttttaattgcaacatattggctataatcttgggttgttgaaaatcaacttggtttgagggataacaccactatagattcaaatactcgccaatcacacaaaaacacttttaaattccttctaccagaaaaaaaatgacaaaaagaaaaacacgtttttaaccagttacagtagtgttactcctcaatccaatgaaattttatgcagttctgttacaaaattatatctgttgtaatatttaaaaaagttaaacttttgcttaaccaatgaaaataagatctcaatagaagacttaaattaaatatgatagtgatacatgagcatatgttcataaatcaactttctgattgattttctatgataaatgcattgactacactattttacttactactacacgtcctttacagaatgcatataaattaaaatatgcaatatatttatattcattgagtgaaaaccgatttgtaagcaaaacagcttacaa

SEQ ID NO: 1906 - DNA, 498 bp, Ctenocephalides felis
ggatatctggcgtcatatgtggttcccaagtatacaatgtatgggcctaatactcctaatgcatttgaaactatagttccaatggaaattcctgtctgcctcaaacaggttggatatgtttccattgcttgcagattcacaacataaaacgtgatgcttatgcaaaatttcattaccacggctaacagtgggaccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgtaa

SEQ ID NO: 1907 - DNA, 498 bp, Ctenocephalides felis
atctgtcacagctccccataattctattataaagtcatctgtaaatccaaatgcttctaagtcggatgaatcgattgcctctgcaaagtccatcgaattactttttcctacggcgtgttcccaaatttgtgtcgccaattcaacatcactgacacccataaacgaatccaatagtgtgttgatacgatctattcctagttgaactttttcatcatgcttaagtgtcttataaactgttattgatgtcttataaatgactttatagtccagtcatttaaacttaaattaggtaagaatctcagaattcgagacacccatctgcacgtctgtaagtacttgtatattgacatttaaaagttgtcccaaaatctacattttaccatcatagaagcattcaccactcgacagagtagtcaatgctcagtttcagccactgttgccccttctgaaaatggaaattgaattattttttaatataatcgaatttatatcaacagc

SEQ ID NO: 1908 - DNA, 420 bp, Ctenocephalides felis; identical to SEQ ID NO: 162

SEQ ID NO: 1909 - DNA, 409 bp, Ctenocephalides felis
  misc_feature (56)..(56): n = unknown
  misc_feature (351)..(351): n = unknown
gcaatttatgacaatattatacaatggacacatccgaaagtataatgaatgtattnaaatataaattaaagtgcgtttttactatttttattttttatgtaaaaatatttaataaattattaagtatttttataaagattattgtatgtttggatttatgagcaataagttctaatatagttcttaaccatacagtcactacatagcctaaatcgtccttttgacaaaataatactttcacaagcacttttcacaaaattcttacgagtcagttttattcgaagtgtcgctgttcttacgaataatatctacattgttcgcctttttttcttggcgcctagtataagccanatcacttgttggaattgaatttttagtgataacaatacgaggtttttctgtcattggt

SEQ ID NO: 1910 - DNA, 498 bp, Ctenocephalides felis
ttggaattcttgacgaaatttgagaagaactttatctcacagggtaattatgagaaccgcacagtatttgaatctttggacattggctggcaattgttgcgtaccttccccaaggagatgttgaagagaatacccgcttccaccctcgccgagttttacccacgtgattctcgtcattaaaaatcttactaaagtttccatcaataccatattttatttccctttatatgatgtcttctccatgtaaagaatattaaatcagtttttgggatgtctggtactaaccacatccttaatgtaaggaaaacatgaagacatgttttaatgtttaaagaaattgtagatacttataaaataatgattctattgttaaaatgaaagtatgttgttgtgaaacagtattctgccgtactagctacaagttgttgaaatattatcaaattttattattatatttgtttttttctgtatgattttaaattacattccatgataatt

SEQ ID NO: 1911 - DNA, 498 bp, Ctenocephalides felis
gaacaatatagataccaaaatcattttgaacgagatggaacttgcgcaagagctcacatggaatctttagttgaaggaaaaataaaattcagacatgtcatgaaagaaaatggagaaaaagttgaatttagtggacagcttagacgtgatgatgaacattccggtaatggatatctgagaatcagttatgaagatacaaatcgagaatcggattatatagtactaaaaagcgattttgataaatttgctattgtgtggagctgcacaattcatccacgaggaaaaatggaattagcttggattctcacacgtgagcaaaacccatcatcggaattgatgaaagaaattaagacatatgtggaaaacaatacacccatagatttgagcaaactaaaacacaccgagcaaaattgtggaaaggattattgaagataattgctgtatataaagtcattttaagacacagctttatcaaaacacaacaacatatgtttaaga

SEQ ID NO: 1912 - DNA, 118 bp, Ctenocephalides felis; identical to SEQ ID NO: 388

SEQ ID NO: 1913 - DNA, 425 bp, Ctenocephalides felis
cttgcttgtggaggcagcagtggattttgctcaatataaccaaaaacaataattacaaacttttgtcaaaaacaagatcataactgtttatataatataagaagttcttataataaaagtgcagtattatttttacatcaatttaaacatcactaaaatcaaaacctaacctcaaaatttcactaagtgaaaatgttgaagactttatttaatcaaagtgtacgacaaaacagcactaatgcctccttagtaagtacagtttttcacaatagaaaccctagaaatttagaacgaatgaggattgcttataaacctgatggatggcatgtagataaacctggacgctcattctggcacaaattagagttaactgaaagctctcgatatataactgcacgagtggtgcattggaaggaaggccctgt

SEQ ID NO: 1914 - DNA, 470 bp, Ctenocephalides felis
cgatccacactagaatctcgtgatggtggccttttgtaatgatcgaaatgatctatagaactttgttgaaccaaactcggtctttctcccacttgtcttgaatttctacgcaaattcgtactgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcacgtgaaaaaaaaaaaaaaaaaaaaa

SEQ ID NO: 1915 - DNA, 498 bp, Ctenocephalides felis
tttacctgaaagtataaatggtgctttcccagaattcctttcccaaaagtaagccgtcaacgctgtaattaaaacgatcaaggcatttcttccagttgaaataaaccataaggttctttttaaaacaggactggagactttcaaatcttttatttgccttaatgttaaaagaaaaactatacagcataaggcaagtatagaatcagctaatctcgcatttgatatcctttgtattagctgcatcaatgtatccacaaatccatgtcctgtataatgcagccctagcaaaccttttgcctgcgcacaaataattattaacgacatcgcggatgtaaaacccgatacgattggggcacttatgaaatcgactaaaaatccaagtttcagtaatcccatcataagttcaatgcaaccagctaaaaagcctagtaaaactacatattcgactggtttttcatgacaatattccaaaaccatcagagcaactaaacttgtggt

SEQ ID NO: 1916 - DNA, 292 bp, Ctenocephalides felis
aaattataagataccggaaacatttaaataaacgatatatgaatatttaatacatcataaaaaagaatttattaaattaaaagaaaatggcgatctactcaatttatctaaaatagtttttaggtgtaagaagattagaactaattctatttgtttactacttttgttactcgtatttaattttgatttaaattatgtatgttattttagaaagcactgataagtataaggaattgttgaactgtattttataagactgctaggcaaatcacgtttatttataaaaaaatgt

SEQ ID NO: 1917 - DNA, 498 bp, Ctenocephalides felis
  misc_feature (58)..(59): n = unknown
ataaaaaaaatcacaataaatagatagttttaacacctatcaacttaaaattatgtgnnacaagcttaaactttgcgtattatgtaaaattaaaatatacaaaaaatatactttgagtaaatatgttgtcaatgatatatcattgatatagaaggctttttatcagctttttataaatttcgataacacagatattgataaataaattacatgtgacccggcaatgcttgaggtccctgcataaatatatttgaccccattcgctgctgatattgcacactttgttgggattcatcgttaggattagaatggcttgatgcaggtatggttcccatgccatttgtaatatgcaatccatttaaatgttgagacatttgatgtattaacataggattagggcctggttgtggttgtcctattggttgaggattattcgctagggacatttgagaactgttctgaatcaattgcatttgtggctgactttgatttactatt

SEQ ID NO: 1918 - DNA, 321 bp, Ctenocephalides felis
cgtggttttggagtatctgttcaaggtatcatcatctaccgtgcagcatactttggattctatgacaccactcgtggaatgttgccagaccccaagaacaccccattagttatcagctgggccattgcacaagccgtcacaactgttgctggtattgtgtcatatccattcgacactgtccgtaggcgtatgatgatgcagtctggacgtgcaaagtctgaaatgttgtacaagggaacactgcactgctgggccaccattgccaagacagaaggaagtggtgccttcttcaagggagctttctccaatatcctccgtggt

SEQ ID NO: 1919 - DNA, 330 bp, Ctenocephalides felis
  misc_feature (134)..(134): n = unknown
  misc_feature (171)..(171): n = unknown
  misc_feature (178)..(178): n = unknown
  misc_feature (311)..(311): n = unknown
  misc_feature (328)..(328): n = unknown
  misc_feature (330)..(330): n = unknown
aaaatggcattatatgcaaattataggctgagcctttataaatctgtgaatgaaccacaccactctatcttctaacctaaagtgcaattttgttttacagaatttctttaataggtaatatttttaattgcagngtatcatattatagtttgtaggtgttatattttattngtaaatngttgttcatatttctcaaacgattgtttatgtattacacagtattaaaataaaccttggatgcaataattgttataacaacattgttgttagtaataaaattttatcagtggattataatcaaaaaaaaaaanaaaaaaaaaaaaaaaanan

SEQ ID NO: 1920 - DNA, 313 bp, Ctenocephalides felis; identical to SEQ ID NO: 1334

SEQ ID NO: 1921 - DNA, 118 bp, Ctenocephalides felis; identical to SEQ ID NO: 1852

SEQ ID NO: 1922 - DNA, 229 bp, Ctenocephalides felis; identical to SEQ ID NO: 377

SEQ ID NO: 1923 - DNA, 313 bp, Ctenocephalides felis; identical to SEQ ID NO: 1334

SEQ ID NO: 1924 - DNA, 196 bp, Ctenocephalides felis
atcatacgcctacggacagtgtcgaatggatatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggt

SEQ ID NO: 1925 - DNA, 269 bp, Ctenocephalides felis
  misc_feature (34)..(34): n = unknown
  misc_feature (62)..(62): n = unknown
agatctactaatgccgcgtttaccactgtcacancaattccgcaaaccagcaaccacaaatntaaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1926 - DNA, 252 bp, Ctenocephalides felis
  misc_feature (56)..(57): n = unknown
cttttggaaaaccgcccaggtacaacatttcagactttgcacgtccagactgcatnnttatacgcctacggacagtgtcgaatgggtatgacacaataccagcaacagttgtgacggcttgtgcaatggcccagctgataactaatggggtgttcttggggtctggcaacattccacgagcggtgtcatagaatccaaagtatgctgcacggtagatgatgataccttgaacagatactccaaaaccacggt

SEQ ID NO: 1927 - DNA, 386 bp, Ctenocephalides felis
  misc_feature (284)..(284): n = unknown
  misc_feature (340)..(340): n = unknown
atttatttccaatttgcaaatatggaaactaccatccctatattatatataattgtatatattcctgaattgttttatttgaatttattttaaacacaaactttaattatattcaaataatgatggacgtgatttcatatatccctaaactttggatcagagtttgagagaagcctagccatagtgtatagaaaattatgtgtaggtgtataattaagattgtcaggagtcaaatatataaagcattgatacaaattatacattccaattttctgtaaacccgngttctttggttgattatggtttatatcacaatttatgaatcatgtaaattaattgnaaatttgaaatgtatctccgatgtaaatgtattaaaaaaaaaaaaa

SEQ ID NO: 1928 - DNA, 498 bp, Ctenocephalides felis
  misc_feature (11)..(11): n = unknown
caataaatatngaatttacaggcttatgaacaccattaagagtaaacctcaatttgatcacagcacccttctctcccaactcaattttcttcgtataccccatgtaattgatatgattagccctttcctcttcctcgaaataaacccaattatgtagacctgttacttcacaattttttaattcagctaagaaaacatgctcaaatgctgaactaccgattttgccacctcctctggagtataaattaaaccaaatcgttttcaataaatccttatgagtttggggatctctagtcacaattcccttttcaataaaaaaattcataagatgtcgcatcaggctggtggataacattgcatctaacaaagcattttcttcatttctttcttgtgcagttacatgttcatttactgcagtatctaattcataattattaaataatggtttcataagcgctatagttttaatatcaaaagctgactgattcacaacaagca

SEQ ID NO: 1929 - DNA, 311 bp, Ctenocephalides felis
attttttgatttatttataaataactttaggtgtccgccactaggggacttccccctacatttagaagtccgtattatttcttacttttaattttattttcttcatttttatattaactctatatctttatctatctatctattagttcaaccaataaaattaagcgtaaaatgaataattttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 1930 - DNA, 385 bp, Ctenocephalides felis
  misc_feature (26)..(27): n = unknown
ggtgggctaatataggatactttatnnttaccgtaggtccaaattagttgacaaaattaaactgagatttgtaataaagattgcaaacattttcaaaaaaaaaaaaaaaattgaaaattttacgatttttttcggaggagggtaattttcaatatacggtttcacagaggggaaaggggatttcaaaaattttcaaaaaaatcgattacgtgattaagtgacgtccccgagcacaaaacttatggttccaaatatatttaaaatattaaaagtccaaatgtccaaaatctgtattacaaatctgtcagtctttttgcaatcctttatcaaatattattttccatcaaagcacacacttttttatacatgcattttccaaatacgt

SEQ ID NO: 1931 - DNA, 282 bp, Ctenocephalides felis
  misc_feature (1)..(1): n = unknown
  misc_feature (4)..(4): n = unknown
  misc_feature (38)..(38): n = unknown
  misc_feature (67)..(67): n = unknown
  misc_feature (233)..(233): n = unknown
nctnggaattcttgacgaaattcgagaagaactttatntcacagggtaattatgagaaccgcacagnatttgaatctttggacattggctggcaattgttgcgtatcttccccaaggagatgttgaagagaatacccgcttccaccctcgccgagttttatccacgtgattctcgccattaaaaatcttactaaagtttccatcaataccatattttatttccctttatatgntggcctctccatgtaaagaatattaaatcaagtttttgggatgtctggt

SEQ ID NO: 1932 - DNA, 279 bp, Ctenocephalides felis
ttggaattcttgacgaaattcgagaagaactttatctcacagggtaattatgagaaccgcacagtatttgaatctttggacattggctggcaattgttgcgtatcttccccaaggagatgttgaagagaatacccgcttccaccctcgccgagttttatccacgtgattctcgccattaaaaatcttactaaagtttccatcaataccatattttatttccctttatatgttgtcctctccatgtaaagaatattaaatcagtttttgggatgtctggt

SEQ ID NO: 1933 - DNA, 350 bp, Ctenocephalides felis
  misc_feature (18)..(18): n = unknown
  misc_feature (64)..(65): n = unknown
tagcttttgctctttgantacttctactctggcgcattaacttttattcaactagattaaattnntggtttacttcctatgcctcacatcagtgtccttcatgtgatcaggagtattttttcgatctggactttgatctgtatcactctcctccatttcagctttgttgcgtttcttttcataaatgagaataatcgcgcataaaattattacttcagcacagatacccaaaaatggccacaaagcagctaatttatcttgaactcgaaccaaggttgtagaattaacagtaattccaatgccttgattagtagcaatacatgtatattctcctcgatcgcttttttcag

SEQ ID NO: 1934 - DNA, 397 bp, Ctenocephalides felis
  misc_feature (14)..(14): n = unknown
aatccgagggattncaactgttttcggtgcctcatccttggcggtcttggttgaagcctctgtcggagataaagctaatttatttttcattgcttctttccatgcctgttgttgctgaaacaaaatattcctaataatagtcatccaggacgatctttcatcgccacttgagcattttatatggaaaattctagatttattttctgaactcgtcagggtaaatgcatataaagacttctgacattcgacaggtggtaaaattctatccagatatatagtctttgcaggtaaaaaactcttcattgttcacaatagtaggttcaagtaaacagtattaaattctcgaacagaaaaatctgatatttcaaacttcttttattgactatggctttgctgg

SEQ ID NO: 1935 - DNA, 424 bp, Ctenocephalides felis
  misc_feature (21)..(21): n = unknown
  misc_feature (55)..(55): n = unknown
  misc_feature (57)..(58): n = unknown
  misc_feature (189)..(189): n = unknown
  misc_feature (220)..(220): n = unknown
ttttttttttttttttttttngagtttttatttttattttcatattgtgccctangnnagatttatacttaaaacaataaaaaatgcgttttattaaaagttgcaagcagttaaataaaatgttgaataaataatagtgataaatcattgcataatgatgcaactcataattattaagtaaattgtctntaacaactactacattatcagatctatccgncacttcttaatattcaataatattatggatatcaggcctcttatcactttatagatttttaattaatctatttaatattaaataaaaaataaatttaaaaccattaaaccgatacattgcctttaaatgaaataaatcaccataacctttattaagcttgtatgtaatatgcaatagcaatttcatataacacactcactaggt

SEQ ID NO: 1936 - DNA, 498 bp, Ctenocephalides felis
  misc_feature (3)..(3): n = unknown
  misc_feature (24)..(24): n = unknown
  misc_feature (31)..(31): n = unknown
  misc_feature (35)..(35): n = unknown
  misc_feature (45)..(45): n = unknown
  misc_feature (52)..(52): n = unknown
  misc_feature (66)..(66): n = unknown
  misc_feature (126)..(126): n = unknown
  misc_feature (140)..(140): n = unknown
  misc_feature (142)..(142): n = unknown
  misc_feature (181)..(181): n = unknown
  misc_feature (481)..(481): n = unknown
aanctgcctgcaagaatgagtttnaggtttncggnccaaacgatntattgcntattaaaggggatncatgtaatttcataaagcttctatatttatatattttaaataatcagaaattactatagntaatgacattttgntngtgctccttacataaaatacaattttatacattttaatntttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatatttttttacaatctcttcgatcggaaaaaaccgtttnacttttgcatgccgtct

SEQ ID NO: 1937 - DNA, 353 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtcgtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagcaaaaaaaaaaaaaaaaaaaaaaaaaa

SEQ ID NO: 1938 - DNA, 446 bp, Ctenocephalides felis
  misc_feature (32)..(32): n = unknown
  misc_feature (63)..(63): n = unknown
  misc_feature (205)..(205): n = unknown
  misc_feature (417)..(417): n = unknown
  misc_feature (422)..(422): n = unknown
  misc_feature (430)..(430): n = unknown
  misc_feature (434)..(434): n = unknown
ggttcattcaagacagagtttggcttaaattnattgaacagttcagagatgcacaggcttgtnttgaatatgaaaaccaacaataaacttggaaaaaaatattttgaatacaaagttaaacgtgctgatcctgaattaaaaaaaggctgtgataaaacctgtcttaaaaatcatttgtgcgcaatagttaccacagttgtatcanatctcatccagtgcaaaaatatcatcaaatcatcatcaagcattcttcagcatttgaatatatatgtcctaggagctattgtaatttccaattatttattattataaagtcatttttgttaagttattataaatttagaataaatcattatgttggaaatatgtaaacgctttgaaaaagctaggatcaaatcaaatatttttagaaaaatncgaanaataaaanaaanaaaaaaaaaaaa

SEQ ID NO: 1939 - DNA, 373 bp, Ctenocephalides felis
  misc_feature (26)..(26): n = unknown
  misc_feature (28)..(28): n = unknown
aacgatattttctccttatccatgancntttttggttctggatggacattaaattataattcatccactgtgatggagaatgaagaattaactcttgacccaaaaacagatgctggagaagcatatcctattggtttagatccaatgtggcagctggctaccaacaaaattattttcttgaactcctttaaaatgaagttgtctatcattttcggcgtcgttcacatgatttttggagtttgcatggccgtattcaatcacgttcatttccgccagaagatcagcatattagtagaatttttgccccaattggtcttcttagttcttctctttgcttacatggtgttcatgatgtttattaaatggattttgt

SEQ ID NO: 1940 - DNA, 395 bp, Ctenocephalides felis
atattatattcacaataatctaatcttccaagttgcggaatgcttgctgtaaatcctcatgtaattgatcaaaatcactcttgatctttgcctcaccatccttgactgggtccttgaacttcattgaggacaactgatatagaatattgcccatagcatctctaatggtattccaggtaatcttgttttcactttgtgcagtagattcagctgcgtattttgccatatcatagaaagcaataatgttacgtaacataccaactgttttatagaaggggcagaaacgatcatatgatgagtagctgttctgctgtaggaaatcgtctttcaagagcttggcaacttcaagtgtgatcttgtcagtttccgccaaggaggctttaccaaccaattgt

SEQ ID NO: 1941 - DNA, 498 bp, Ctenocephalides felis
  misc_feature (392)..(392): n = unknown
  misc_feature (434)..(434): n = unknown
  misc_feature (440)..(440): n = unknown
  misc_feature (446)..(446): n = unknown
  misc_feature (466)..(466): n = unknown
  misc_feature (485)..(485): n = unknown
taatgtcgtagaaggtgaaaaactgcgagttgtttgcacagttgtaggcaaacctacaccaacggtgtcatggaaagttattaatgaggcttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcaacaaagctgaaatggaggagagtgatacagatcaaagtccanatcgaaaaaatcttctgatcacatgaaggacactgatgtgangcatangaagtnaaccaaaaatttaatctagntgaataaaagtcatgcccngagtggaagtaat

SEQ ID NO: 1942 - DNA, 426 bp, Ctenocephalides felis
ccaatggaaattcctgtctacctcaaactggttggatatgtttccattgcttgcagattcacaacataaaacgtaatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgtaaactttt

SEQ ID NO: 1943 - DNA, 281 bp, Ctenocephalides felis
  misc_feature (28)..(28): n = unknown
acaaaattcaattcaatttattcaatgntaatcatgtgttttcgttttttatattataattattcaagaagcgtaatttattttttttatgaaaacattttataaatgtggagcaacaaagttttattgcagtttctaacgcgagtggtcaaaaaaagttgcaaaataccaaatttcaagattttgatatgaaattattcaataattaaatatcttataaaagggcggagctaaatcataaaaaaaaattaaatatcatgttaaaattttgcatggtttgt

SEQ ID NO: 1944 - DNA, 475 bp, Ctenocephalides felis
  misc_feature (14)..(14): n = unknown
  misc_feature (32)..(32): n = unknown
  misc_feature (54)..(54): n = unknown
  misc_feature (58)..(58): n = unknown
  misc_feature (86)..(86): n = unknown
  misc_feature (473)..(473): n = unknown
tggacaaccattcnaaattccaaaaggaaatntactattgaatgattaaatgtnatanattaatcaaattttagatgattaaaatngttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatntt

SEQ ID NO: 1945 - DNA, 204 bp, Ctenocephalides felis; identical to SEQ ID NO: 697

SEQ ID NO: 1946 - DNA, 498 bp, Ctenocephalides felis
  misc_feature (214)..(214): n = unknown
  misc_feature (316)..(316): n = unknown
  misc_feature (328)..(328): n = unknown
  misc_feature (334)..(334): n = unknown
  misc_feature (362)..(362): n = unknown
  misc_feature (372)..(372): n = unknown
  misc_feature (401)..(401): n = unknown
  misc_feature (404)..(404): n = unknown
  misc_feature (433)..(433): n = unknown
  misc_feature (449)..(449): n = unknown
  misc_feature (451)..(451): n = unknown
  misc_feature (455)..(455): n = unknown
  misc_feature (463)..(464): n = unknown
  misc_feature (470)..(470): n = unknown
  misc_feature (492)..(492): n = unknown
  misc_feature (496)..(496): n = unknown
gaggagactttgtttaccgtaatggacatccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatntttttgatgactctaataaaaaaaatgtataaatggccatgcctgatatatttttgataaccttaatgaaaaaatgtttaaatggccatgactgaaaagatnctatgtgtattnttttgncaacatttattggtgaatgggataaaanataaatccanttataagctgtttggataaattaatttgnatnaatccataatcttagaattggtaaggtanccaaattaaatttggncncaancacaaaanntttccnaatttacctttttgatttttgngganat

SEQ ID NO: 1947 - DNA, 498 bp, Ctenocephalides felis
gaggagactttgtttaccgtaatggacaaccattcgaaattccaaaaggaaatttactattgaatgattaaatgtaatagattaatcaaattttagatgattaaaattgttctattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatatac

SEQ ID NO: 1948 - DNA, 235 bp, Ctenocephalides felis
  misc_feature (27)..(27): n = unknown
  misc_feature (99)..(99): n = unknown
  misc_feature (106)..(106): n = unknown
  misc_feature (109)..(109): n = unknown
  misc_feature (115)..(115): n = unknown
  misc_feature (158)..(158): n = unknown
tgaatcctaattagtctattcaagatngttttcctggtttaagccttacttaggcaatctcacttttgcattcttcgccgggtggcgtgggtatgcatngcaactncgntttatnaaagtgcaagccatttggacaatcataatgtgttatttgccanttgttggtaaccaagaaacattgataatattttttacaatctcttcgatcggaaaaaacgctttcacttttgcatgc

SEQ ID NO: 1949 - DNA, 269 bp, Ctenocephalides felis; identical to SEQ ID NO: 441

SEQ ID NO: 1950 - DNA, 446 bp, Ctenocephalides felis
  misc_feature (34)..(34): n = unknown
  misc_feature (64)..(64): n = unknown
  misc_feature (437)..(437): n = unknown
ttggtccaactgtttggcatttgtggatatattnaaaatcagccaatgctaattttttttcggngttacattggcatttgctacagcacagatttttttagtcactgatatcttatttgcctatattaaaagagaatataccttgaagagtggcttgaaacgaatattgaaaggcaaacctgcaaaattagctttagaataattttattataatgtttgaattgaaatgtatttgaatttaaatatgagttaagttttaaataaaagcttttttatttttacattataatattatgccattagcctatattgttacacagttaaatttaaatgtatttaataaatgggtttacaactaaacaaatcacaaacacacataaatataataaaaactggatgaaaataattgaatatatatataaatagtaaaaaaaaanaaacaaaaa

SEQ ID NO: 1951 - DNA, 297 bp, Ctenocephalides felis
  misc_feature (35)..(35): n = unknown
  misc_feature (53)..(53): n = unknown
  misc_feature (164)..(164): n = unknown
ctacaggattccttaaccggatctgctcctatttncggacaatactgcatttngggtgaactgcacgaattcacgcaactaaattttacttttttacatttttgctcgggtttcggtacaggtgtaggttcaggagtaggtactactcctggtgcgggctcatncaatgacgcaaatacttctttatttactgttaaaggcgttccgtcgacattaaactcaccatcataagcggtaacgacagataacgccacaaaactaataaaaaccaatgtgatataaaacattctaataaat

SEQ ID NO: 1952 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccgcccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattcatgtatctttttaataa

SEQ ID NO: 1953 - DNA, 269 bp, Ctenocephalides felis
  misc_feature (30)..(30): n = unknown
agatctactaatgccgcgtttaccactgtnacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1954 - DNA, 498 bp, Ctenocephalides felis
  misc_feature (34)..(34): n = unknown
taccttttgctaccgatgctcaagggcgataacngacccacagccaggcgtccaaaatgcttgctcgtccgcaacgacatagtcgttttgcaagatttatccatgtataattttcgccattcgtatccaaaattctctttggatcttgatcatgttaaagttgctttaacggcattggctcgtatgcatgcaagttgcattatctacgagaagaaaaaaaattgttgcatggggagagtttacaaagatcttatgttcgagactatggccaacaataatcaatggtggagaactggtgaggatactgctttagcaattgctgaggaatctgagaaattcggcaaatataccgaataccattccatggtccaggagaagttaattgatttcctgagattggcatggtctatggtaaaaccatcgcgcatttataagaatgtggtatgccaccgcgatacgcgcaatcacaatttgatgttcaaatataattcaactggt

SEQ ID NO: 1955 - DNA, 497 bp, Ctenocephalides felis
  misc_feature (29)..(30): n = unknown
  misc_feature (37)..(37): n = unknown
  misc_feature (46)..(46): n = unknown
  misc_feature (58)..(58): n = unknown
  misc_feature (148)..(148): n = unknown
  misc_feature (235)..(235): n = unknown
  misc_feature (250)..(250): n = unknown
  misc_feature (254)..(254): n = unknown
  misc_feature (268)..(268): n = unknown
  misc_feature (276)..(276): n = unknown
  misc_feature (279)..(279): n = unknown
  misc_feature (313)..(313): n = unknown
  misc_feature (320)..(321): n = unknown
ttttttttttttttttttttttttttttnnataaagnatttattgnttttttacaggnataaataaaatttcttaacttaatagcgcaagaagcatattgtataaaaaaagcttttgtataaagttcttatttttattttcatattgngccctaataagatttatacttaaaacaataaaaaatgcgttttattaaaagttgcaagcagttaaataaaatgctgaataaataatngtgataaatcattgnatantgatgcaactcatnattattancgnaaattggctataacaactactacattatcagatntatccgnnacttcttaatattcaataatattatggatatcaggcctcttatcactttatagatttttaattaatctatttaatattaaataaaaaataaatttaaaaccattaaaccgatcattgcctttaaatgaaataaatcaccataacctttattaagcttgtatgtaatatgcaatagg

SEQ ID NO: 1956 - DNA, 498 bp, Ctenocephalides felis
  misc_feature (57)..(57): n = unknown
attattcataagacatcaaagactttattacataagggacaacatagtaattaaagntacagaaacaatgcagagtcaatacttcgattgcttataggaattcatggaggtcgaagaaatttctagtatatttttgatttcaaattttaatactcagttaatggtatgaatgctaagtctctctctactttattcatatatgacaatattgcacatttgtgcacgaaaccttgagttgaatttttcagagatagttatgcatgaaatgttgaataccagtatttgctccaacggccttcctgcatgcgtctatatggaagctatgaactcattttaaagttgaagattttatggaattaattataagagcataatgactctgagtttgaggaacttgcttatgtttaactaaatcatttgtcaacaacatttaaagtcggaactgttcacaactggaaacaggatatctgcatttataatactttaataataattgca

SEQ ID NO: 1957 - DNA, 498 bp, Ctenocephalides felis
  misc_feature (30)..(31): n = unknown
  misc_feature (59)..(60): n = unknown
  misc_feature (344)..(344): n = unknown
  misc_feature (487)..(487): n = unknown
tagtctaaatgttttatttgtttctttctnnagttaatcaatatttgacattttatatnntaatattgaataatttaatttttattatttggctctcggataatcggtcaataaaaaaaaaaatatgaatgaatgatatttaacacgcatattattattatactatttgttctttgagtgtgtatgatgctccgtgttattattttgaactcgactccattcggagtctatgcaaaggcatatatatgtgagtgtgtgtaagaatatttttcaaagattatatttgctttactttttaatagataatattatatttttgttaatgttaatgactatattatggntattttgttctttttgagctctatttatgaaattttatgctgagacaaaattgccggtagtattaagtgtgcattcatgccataactccaaacttttgttagaataattcacaattttatgtcagaggtattatatagggtgnaaaacaattta

SEQ ID NO: 1958 - DNA, 331 bp, Ctenocephalides felis
  misc_feature (54)..(54): n = unknown
tttttttttttttttttttttttttttgatttatttataaataactttaggtgnccgccactaggggacttccccctacatttagaagtccgtattatttcttacttttaattttattttcttcatttttatattaactctatatctttatctatctatctattagttcaaccaataaaattaagcgtaaaatgaataattttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 1959 - DNA, 330 bp, Ctenocephalides felis
  misc_feature (58)..(58): n = unknown
  misc_feature (84)..(84): n = unknown
  misc_feature (92)..(92): n = unknown
ttttttttttttttttttttttttttttttttatttataaataactttaggtgtccgngctaggggacttccccctacatttanaagtccgnattatttcttacttttaattttattttcttcatttttatattaactctatatctttatctatctatctattagttcaaccaataaaattaagcgtaaaatgaataattttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 1960 - DNA, 261 bp, Ctenocephalides felis
  misc_feature (59)..(59): n = unknown
tctcggtggaatcgatttctgtagtttctttgcaaactgacaatattagagccaataantatttcttagaaacatcaacagcccacgtagtctgtgcaagattggtagttggtatatccgtaatgataatctgaggttgttgctggtttaccgattgttgctggtttatcgattgttgctggtttagcaattgctgctgttgccagagaaatttttgttcctgaactttttggtattgtcgcaactgctgttgatgtaagt

SEQ ID NO: 1961 - DNA, 131 bp, Ctenocephalides felis
cttttgcatgtaggatccaatggatcgcgaaatattccaactcttggacaaatgaatggttgctgccaaatacgaacgctgctggaatttgtttcaactggaattagttcttgagactccaaagacaatgt

SEQ ID NO: 1962 - DNA, 261 bp, Ctenocephalides felis
  misc_feature (28)..(29): n = unknown
tctcggtggaatcgatttctgtagtttnntcgcaaactgacaatattagagccaataaatatttcttagaaacatcaacagcccacgtagtctgtgcaagattggtagttggtatatccgtaatgataatctgaggttgttgctggtttaccgattgttgctggtttatcgattgttgctggtttagcaattgctgctgttgccagagaaatttttgttcctgaactttttggtattgtcgcaactgctgttgatgtaagt

SEQ ID NO: 1963 - DNA, 486 bp, Ctenocephalides felis
  misc_feature (29)..(29): n = unknown
  misc_feature (59)..(59): n = unknown
tgaaatgtgaagacgacgtcaacgaatgntttgacccaaaatctttctcgtgcagaacngcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaagtaaaaaa

SEQ ID NO: 1964 - DNA, 500 bp, Ctenocephalides felis
  misc_feature (124)..(124): n = unknown
  misc_feature (126)..(126): n = unknown
  misc_feature (149)..(149): n = unknown
ttttttttttttttttttggcccaaacgatttatttttattaaaaagatacatgtaatttcataaagcttctatatttatatattttaaataatcagaaattactatagttaatgacattttgntngtgctccttacataaaatacaantttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcccgagaaagatttggg

SEQ ID NO: 1965 - DNA, 167 bp, Ctenocephalides felis
aatgcaatagatagtttttgtcaattgatttaatcgcttaggagcgcactgatactcacagaatcctctatatccacttggctcaatctcatttaactgtcaccaattttaaatcaaatcagcaacattcattggcatctcatcgatgtgtgtattgtagaattgct

SEQ ID NO: 1966 - DNA, 498 bp, Ctenocephalides felis; identical to SEQ ID NO: 501

SEQ ID NO: 1967 - DNA, 498 bp, Ctenocephalides felis
  misc_feature (33)..(34): n = unknown
aacatttcagactttgcacgtccagactgcatnntcatacgcctacggacagtgtcgaatggatatgacacaataccagcaacagttgtgacggcttgtgcaatggcccagctgataactaatggggtgttcttggggtctggcaacattccgcgagcggtgtcatagaatccaaagtatgctgcacggtagatgatgataccttgaacagatactccaaaaccacggtacaatccagggagaccatcaggcttgaagattttggtcaagcagttgcccaatccagagaattcacgttgaccagcgcctttacctacatcagcggccaatctggtacgggcgaaatcaagtgggtagacgaagcacaatgatgtggctccagcagcaccaccagatgccaagtttcctgcgaagtaacgccagaattgggtcttcttgtcaactccacccaagaaaacttgcttgtacttgtctttgaatgcgaagttcaaagcctga

SEQ ID NO: 1968 - DNA, 498 bp, Ctenocephalides felis
  misc_feature (26)..(26): n = unknown
agaaatatgataatatgttcaaaatnaaaatgataaaaataaatgagtggattatcaaaacaggatattaaacataatagaaattttttttgaaagttatggaaattttttaagaaaaggttaatgacaaagttgaattaattacctgtatgtttgaatatttgttagcacttttgcactaaacaagcttttttaacaaaaatgattttgtgagttaattttccgccgaataattagattttgtaaatacaaaattactaaaaaatttgtcttttttaaaattattatttgaaaacacgaataatattgttctctggatgttgttcgattggttttcgaaaattaactaaatgaaactggtgtgccctttgtaacacgtgtaaacacttgaacgagagatgtgagattgtatgtgtgtgtttttatatgtcagggtgtgaatacttaaattgttgatcttaaaaggaagtcgatattaattgttgtcaaaaagtgtaa

SEQ ID NO: 1969 - DNA, 442 bp, Ctenocephalides felis
cggaagtgtgagctggcacatttgacttaactttagttttatcttcatactcaattatattttcttttaccatttctccagcagaaggtgtcacattctgtgtttctaaatttgtattttgataatcatcactaaatctatttcgggatcgagaccgcgatctgcttcttctacctcttaattctttccttgtaacaaactccaaaaatccttcagaatctggcatcacaacaggttcttcaggttgtgaatccgcttcttgcacgcataattggaaaattggttgtgttttgggtgttccagctgaatgtttttcaaaaatattcgattccgtgatttgtggcacttgagaaggcaattcgctattagctttgataccaacaatagacgcccatgatgtcagttttggttgttcagtagactcacatagcggttgttcagt

SEQ ID NO: 1970 - DNA, 463 bp, Ctenocephalides felis
gaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatacagcattcatttataattgtttaagaattataatgattttatgaagtttagtatatgttcaccaatgtaacaccaatggcagtgttataatctgtgatatatatatgaggtaaattatattccgaaaaatgatgaacctagaacta

SEQ ID NO: 1971 - DNA, 291 bp, Ctenocephalides felis
  misc_feature (262)..(262): n = unknown
aagtccgtaaagactgtgctgactgcttaaaacttactgacaactaaattagtttaggaattttataacaaactgtaatttgcttaaatttgctttatgatcagctagttgtatattatttgtaatttgatggttttagttttttatgtaacattttgacaaataaaaattgtttatgaaaataaaaaaaaaaaaaaaaaaaaaaatttaaaaaaaaaaaaaaaaaaaaaaaaaaaaaaaaaaaaaaaaaaaaaaaaaaaanttaaaaaaaaaaaaaaaaaaaaaaaaaaa

SEQ ID NO: 1972 - DNA, 269 bp, Ctenocephalides felis
  misc_feature (34)..(34): n = unknown
  misc_feature (64)..(64): n = unknown
agatctactaatgccgcgtttaccactgtcacanttattccgcaaaccagcaaccacaaatatnaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1973 - DNA, 386 bp, Ctenocephalides felis
  misc_feature (28)..(28): n = unknown
atatatcttacatcgaatctaataacantaaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1974 - DNA, 494 bp, Ctenocephalides felis
  misc_feature (27)..(27): n = unknown
  misc_feature (140)..(140): n = unknown
  misc_feature (216)..(216): n = unknown
  misc_feature (255)..(255): n = unknown
  misc_feature (336)..(336): n = unknown
  misc_feature (341)..(341): n = unknown
  misc_feature (384)..(384): n = unknown
  misc_feature (406)..(406): n = unknown
tttttttttttttttttttttttttcnaacggcccaaacgatttatttttattaaaaagatacatgtaatttcataaagcttctatatttatatattttaaataatcagaaattactatagttaatgacattttgtttgngctccttacataaaatacaattttatacattttaatttttatacatattttttatatttaattgcacagatcattngggtatttattatattaattgactactttatgataattngaatcctaattagtctattcaagattgttttcctggtttaagccttacttagcaatctcacttttgcattcttcgccgggnggcgngggtatgcatcgcaactccgttttatcaaagtgcaagccattnggacaatcataatgttttattngccatttgttgtcaaccaagaaacattgataatattttttacaatctcttcgatcggaaaaaacgttttcacttttgcatgcagttct

SEQ ID NO: 1975 - DNA, 500 bp, Ctenocephalides felis
  misc_feature (56)..(56): n = unknown
  misc_feature (135)..(135): n = unknown
  misc_feature (211)..(211): n = unknown
  misc_feature (216)..(216): n = unknown
  misc_feature (227)..(227): n = unknown
  misc_feature (230)..(230): n = unknown
  misc_feature (285)..(285): n = unknown
  misc_feature (291)..(291): n = unknown
  misc_feature (301)..(301): n = unknown
  misc_feature (330)..(330): n = unknown
  misc_feature (336)..(336): n = unknown
  misc_feature (351)..(351): n = unknown
  misc_feature (360)..(360): n = unknown
  misc_feature (400)..(400): n = unknown
  misc_feature (406)..(406): n = unknown
  misc_feature (427)..(427): n = unknown
  misc_feature (436)..(436): n = unknown
  misc_feature (451)..(451): n = unknown
  misc_feature (491)..(491): n = unknown
ttttttttttttttttttttttttcttgacaattttacttgtatttatcttaaacntatttacagtatttcttcaaaaactgtcaaatacaataagttaacttaaatacatggatgttctgagaatgtggatganctcaagattgtagaactgagtttgatctacacaatttttgcctaaaaggttcgctactcagaaagcagccacccgngattncataccgcctngcntttgagaataaaatatatgtataatgttaaataggattttaatgggaaaaagccnatttantactttagcnttatgaatatgcatttccaaattattctntaacgnatttaacctaaaatncaagaaatncatattcataaatatacatatattttaatacaaaaaggtnacttgngcaaaaatgaaattcaaatcncttggcttngctaatttaaattgnttttagatttttctctttttttggtatgggtgcctattgnttaatttac

SEQ ID NO: 1976 - DNA, 498 bp, Ctenocephalides felis
  misc_feature (28)..(28): n = unknown
atgaacaatttatacttaatagaatagnacaagcaacattcgacaacttttcaatggctgtggtactatttcgtgcatcgaagtcgttaaaggaaaattcgcctactgccaaacatgaagaactcatggcaaaagcatggtgttttgaggcttcagaacgcctagaggcaaatttaaaacatgtagtaagcggtaagcatttagatttatataccaaattagctacaataggcaaaaattcatgcgctgccaatggagttccgcaaaataatccattaaatttgtaataaatattaagtatgtgtaactaagcttaagttcatttaatttattttattgataaatactttaatttaacagaatgtaaatatttcattttatgtaaataattagggggtatttgttatcaagatcgtgcgccaaataagccttgtcatacagattattttcaattttgataataaggtaatacaatgcgccttggtacattttgtaatc

SEQ ID NO: 1977 - DNA, 481 bp, Ctenocephalides felis
  misc_feature (29)..(29): n = unknown
  misc_feature (58)..(58): n = unknown
tgaaatgtgaagacgacgtcaacgaatgntttgacccaaaatctttctcgtgcagaantgcatgcaaaagtgaaaacgttttttccgatcgaagagattgtaaaaaatattatcaatgtttcttggttaacaacaaatggcaaataaaacattatgattgtccaaatggcttgcactttgataaaacggagtcgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgactccc

SEQ ID NO: 1978 - DNA, 251 bp, Ctenocephalides felis; identical to SEQ ID NO: 664

SEQ ID NO: 1979 - DNA, 498 bp, Ctenocephalides felis
caataaatattgaatttacaggcttatgaacaccattaagagtaaacctcaatttgatcacagcacccttctctcccaactcaattttcttcgtataccccatgtaattgatatgattagccctttcctcttcctcgaaataaacccaattatgtagacctgttacttcacaattttttaattcagctaagaaaacatgctcaaatgctgaactaccgattttgccacctcctctggagtataaattaaaccaaatcgttttcaataaatccttatgagtttggggatctctagtcacaattcccttttcaataaaaaaattcataagatgtcgcatcaggctggtggataacattgcatctaacaaagcattttcttcatttctttcttgtgcagttacatgttcatttactgcagtatctaattcataattattaaataatggtttcatagcgctatagtttaatatcaaaaggctgactgattcacaacaggcaa

SEQ ID NO: 1980 - DNA, 412 bp, Ctenocephalides felis
acacaattagcaataggaaaatctagccacaaatatttttaacaatttatttaatacttatgttctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatataaataacgg

SEQ ID NO: 1981 - DNA, 269 bp, Ctenocephalides felis
aagtataattgcatttcacaacacacgacggaaatatggttatggtccatatgaagcagtgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 1982 - DNA, 500 bp, Ctenocephalides felis
  misc_feature (55)..(55): n = unknown
  misc_feature (95)..(95): n = unknown
  misc_feature (97)..(97): n = unknown
  misc_feature (166)..(166): n = unknown
  misc_feature (173)..(173): n = unknown
  misc_feature (175)..(175): n = unknown
  misc_feature (178)..(178): n = unknown
  misc_feature (293)..(293): n = unknown
  misc_feature (330)..(330): n = unknown
  misc_feature (341)..(341): n = unknown
  misc_feature (458)..(458): n = unknown
tttttttttttttttttttttttttttttcataaagcttctatatttatatatgntaaataatcagaaattactatagttaatgacattttgttngngctccttacataaaatacaattttatacattttaatttttatacatattttttatatttaattgcacanatcattngngtntttattatattaatggactactttatgataattggaatcctaattagtctattcaagattgttttcctggtttaagccttacttagcaatctcacttttgcattcttcgccgggnggcgtgggtatgcatcgcaactccgttttatcaaagngcaagccattnggacaatcataatgttttatttgccatttgttgttaaccaagaaacattgataatattttttacaatctcttcgatcggaaaaaacgttttcacttttgcatgcagttctgcacganaaagattttgggtcaagccattcggtggccgtcgtctttaca

SEQ ID NO: 1983 - DNA, 386 bp, Ctenocephalides felis; identical to SEQ ID NO: 498

SEQ ID NO: 1984 - DNA, 270 bp, Ctenocephalides felis
  misc_feature (2)..(2): n = unknown
anatctactaatgccgcgtttaccactgtcacagcaattccgcaaaccagcaaccacgggatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 1985 - DNA, 386 bp, Ctenocephalides felis; identical to SEQ ID NO: 498

SEQ ID NO: 1986 - DNA, 349 bp, Ctenocephalides felis
  misc_feature (55)..(55): n = unknown
  misc_feature (66)..(66): n = unknown
  misc_feature (72)..(73): n = unknown
  misc_feature (106)..(106): n = unknown
  misc_feature (163)..(163): n = unknown
  misc_feature (181)..(181): n = unknown
  misc_feature (194)..(194): n = unknown
  misc_feature (210)..(210): n = unknown
  misc_feature (231)..(231): n = unknown
  misc_feature (264)..(264): n = unknown
tttttttttttttttttttttttttttttcaagtatttatttattctctttatgnttttgaacatngacggnnttaacattttttacctatgagtatgtacatatntcttacatcgaatctaataacaataaagagttattaattttcatgtcgatgttttanaaaatgattcagtagcancttctgaattttntttgtaattgataatnctttctcaaagtataattgcntttcacaacacacgacggaaatatggttatggnccatatgaagcaatgctcgttcttctatccacttgcttctgataaatgttcggtataaagaatgcaatcactccacatgctatca

SEQ ID NO: 1987 - DNA, 487 bp, Ctenocephalides felis
  misc_feature (34)..(34): n = unknown
  misc_feature (38)..(38): n = unknown
  misc_feature (48)..(48): n = unknown
  misc_feature (53)..(53): n = unknown
  misc_feature (56)..(56): n = unknown
  misc_feature (74)..(74): n = unknown
  misc_feature (101)..(101): n = unknown
  misc_feature (121)..(121): n = unknown
  misc_feature (144)..(144): n = unknown
  misc_feature (157)..(157): n = unknown
  misc_feature (164)..(164): n = unknown
  misc_feature (179)..(179): n = unknown
  misc_feature (182)..(182): n = unknown
  misc_feature (200)..(201): n = unknown
  misc_feature (211)..(211): n = unknown
  misc_feature (224)..(224): n = unknown
  misc_feature (232)..(232): n = unknown
  misc_feature (261)..(261): n = unknown
  misc_feature (319)..(319): n = unknown
  misc_feature (351)..(351): n = unknown
  misc_feature (393)..(393): n = unknown
  misc_feature (419)..(419): n = unknown
tttttttttttttttttttttttttttttcaagnattnatttattctntttanggnttttgaacattgacggcnttaacattttttacctatgagtatgtncatatatcttacatcgaatntaataacaataaagagttattanttttcatgtcgangttttanaaaatgattcagtancancttctgaattttctttgnnattgataatnctttctcaaagtntaattgcntttcacaacacacgacggaaatatggttntggtccatatgaagcaatgctcgttcttctatccacttgcttctgataaatgttcggnataaagaatgcaatcactccacatgctatcanagatgttcctggtattaaaaatgttaaatcgcaattataatntagaattattcctacaacattgcttncaacaacacttcctaatcgacccatcattaaagatatcatactgccattgccctgagttgtgtagggt

SEQ ID NO: 1988 - DNA, 379 bp, Ctenocephalides felis
tttgcagactgtactttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaacattctaataaatatgttacccagc

SEQ ID NO: 1989 - DNA, 118 bp, Ctenocephalides felis
  misc_feature (28)..(28): n = unknown
  misc_feature (55)..(55): n = unknown
catcaccgagaagaactcttcggctacngaatatcttcattggaggcgcgttgtnggtgcacgcagcattaacaaggttcttgcaattcagcataatgaccagaagaaaaatacaggt

SEQ ID NO: 1990 - DNA, 118 bp, Ctenocephalides felis
  misc_feature (27)..(28): n = unknown
catcaccgagaagaactcttcggctanngaatatcttcattggaggcgcgttgtgggtgcacgcagcattaacaaggttcttgcaattcagcataatgaccagaagaaaaatacaggt

SEQ ID NO: 1991 - DNA, 210 bp, Ctenocephalides felis; identical to SEQ ID NO: 416

SEQ ID NO: 1992 - DNA, 500 bp, Ctenocephalides felis
  misc_feature (172)..(172): n = unknown
  misc_feature (181)..(181): n = unknown
  misc_feature (336)..(336): n = unknown
  misc_feature (464)..(464): n = unknown
  misc_feature (468)..(468): n = unknown
tttttttttttttttttttttttttttttttatttcataaagcttctatattgatatattttaaataatcagaaattactatagttaatgacattttgtttgtgctccttacataaaatacaattttatacattttaatttttatacatattttttatatttaattgcacanatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagngcaagccatttggacaatcataatgttttatttgccatttgttgttaaccaagaaacattgataatattttttacaatctcttcgatcggaaaaaacgttttcacttttgcatgcagttctgcacganaaanaatttgggtcaaaccattcgtggacgcgtctt

SEQ ID NO: 1993 - DNA, 498 bp, Ctenocephalides felis; identical to SEQ ID NO: 464

SEQ ID NO: 1994 - DNA, 245 bp, Ctenocephalides felis
ggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgtactttgcagactgtactttctttagtggtgcactg

SEQ ID NO: 1995 - DNA, 386 bp, Ctenocephalides felis; identical to SEQ ID NO: 468

SEQ ID NO: 1996 - DNA, 482 bp, Ctenocephalides felis
  misc_feature (58)..(58): n = unknown
tgaaatgtgaagacgacgtcaacgaatggtttgacccaaaatctttctcgtgcagaantgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattta

SEQ ID NO: 1997 - DNA, 482 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctggttatttaaaatatattaattttggaagctttatgaattta

SEQ ID NO: 1998 - DNA, 218 bp, Ctenocephalides felis
  misc_feature (51)..(51): n = unknown
tttttttttttttttttttttttgctctatatctttatctatctatctatnggttcaaccaataaaattaagcgtaaaatgaataattttgattagaacaaatatattcatggatttaaaaaaatctaaattgtaaaattcttaaatgccttatcatatttgcgagcctgtgttcaaccataatatttttttatataacacataaagtaaaacaaagt

SEQ ID NO: 1999 - DNA, 423 bp, Ctenocephalides felis
  misc_feature (58)..(58): n = unknown
gatcggttgcaatttgtcattgcaccaagcataaattgatgggtccggtgcataggtnataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2000 - DNA, 257 bp, Ctenocephalides felis
  misc_feature (4)..(4): n = unknown
  misc_feature (49)..(49): n = unknown
  misc_feature (65)..(65): n = unknown
  misc_feature (67)..(68): n = unknown
  misc_feature (125)..(125): n = unknown
  misc_feature (138)..(138): n = unknown
  misc_feature (147)..(147): n = unknown
  misc_feature (181)..(181): n = unknown
  misc_feature (184)..(184): n = unknown
  misc_feature (210)..(210): n = unknown
  misc_feature (240)..(240): n = unknown
  misc_feature (243)..(243): n = unknown
gtgngatgttacttaacataataataactttttaaaattgtgtgatcanatttctaatggggcanannaaagccagttatgataagaaccaagcctatttcatgtgaaggttacttctccacagnattattatctatntcaagtttncttctggtcattatgctgaattgcaagaaccttnttnatgctgcgtgcaccaacaacgcgccntgcaatgaagatattcctgtagccgaaganttnttctcagtgatggt

SEQ ID NO: 2001 - DNA, 481 bp, Ctenocephalides felis
  misc_feature (60)..(60): n = unknown
  misc_feature (437)..(437): n = unknown
tgaaatgtgaagacgacgtcaacgaatggtttgacccaaaatctttctcgtgcagaaggngcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaanttctgattatttaaaatatattaatatagaagctttatgaaatt

SEQ ID NO: 2002 - DNA, 131 bp, Ctenocephalides felis
  misc_feature (56)..(56): n = unknown
attgtctttggagtctcaagaactaattccagttgaaacaaattccagcagcgttngtatttggcagcaaccattcatttgtccaagagttggactatttcgcgatccattggatcctacatgcaaaaggt

SEQ ID NO: 2003 - DNA, 209 bp, Ctenocephalides felis
  misc_feature (53)..(53): n = unknown
tttttttttttttttttttttttttttaacaatgcttaaaactttatatattnacaaacaattaatataattgcatttaaaacttatatataattttttaatattaattttctccaaatcggttcatcaagctgataactttcttataaaccaaatctacagagtcgattccccacaaatagtccaaatgattgaatttgccatctggt

SEQ ID NO: 2004 - DNA, 482 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattta

SEQ ID NO: 2005 - DNA, 329 bp, Ctenocephalides felis
  misc_feature (31)..(31): n = unknown
caatcagcttctgacgatttctttttacacntatttttagaatgatcatacacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2006 - DNA, 498 bp, Ctenocephalides felis
atgacttacctgaaaacacgacctccaagtatggaagtaaatgctattgatatgattatagacctcacaaaaaaatataaagttaggtctcacatagtgcatctatcagcagcaggtgctttaccgcaattgaaaaaagcgcgctcagagaacgttccactttcgattgaaacttgtcatcattacttaacctttgctgctgaagatgttccagatggacatactgaatacaaatgcgctccaccaattagagaagaaagtaatcaagaaaaattatggcaagctttggaaaacagagatattgatatggtagtcagtgatcattctccatcacctgctgcactgaaaggcctgtgcaatggttgtcatcctgatttcctaaaagcttggggtggaattgctggtatgcagtttggattatctttattatggaccggtgcttctaaaagaggctttaaagctcatgatgtatctcgtttattatctgcgggacctgcg

SEQ ID NO: 2007 - DNA, 386 bp, Ctenocephalides felis; identical to SEQ ID NO: 498

SEQ ID NO: 2008 - DNA, 423 bp, Ctenocephalides felis
  misc_feature (13)..(13): n = unknown
  misc_feature (57)..(57): n = unknown
gatcggttgcaanttgtcattgcaccaagcataaattgatgggtccggtgcataggntataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2009 - skipped

SEQ ID NO: 2010 - DNA, 423 bp, Ctenocephalides felis
  misc_feature (405)..(405): n = unknown
gatcggttgcaatttgtcattgcaccaagcataaattgatgggtccggtgcataggtgataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgntcccaactgcttattagt

SEQ ID NO: 2011 - DNA, 257 bp, Ctenocephalides felis; identical to SEQ ID NO: 2000
  misc_feature (4)..(4): n = unknown
  misc_feature (49)..(49): n = unknown
  misc_feature (65)..(65): n = unknown
  misc_feature (67)..(68): n = unknown
  misc_feature (125)..(125): n = unknown
  misc_feature (138)..(138): n = unknown
  misc_feature (147)..(147): n = unknown
  misc_feature (181)..(181): n = unknown
  misc_feature (184)..(184): n = unknown
  misc_feature (210)..(210): n = unknown
  misc_feature (240)..(240): n = unknown
  misc_feature (243)..(243): n = unknown

SEQ ID NO: 2012 - DNA, 481 bp, Ctenocephalides felis; identical to SEQ ID NO: 2001
  misc_feature (60)..(60): n = unknown
  misc_feature (437)..(437): n = unknown

SEQ ID NO: 2013 - DNA, 131 bp, Ctenocephalides felis; identical to SEQ ID NO: 2002
  misc_feature (56)..(56): n = unknown

SEQ ID NO: 2014 - DNA, 498 bp, Ctenocephalides felis
  misc_feature (14)..(14): n = unknown
  misc_feature (58)..(58): n = unknown
  misc_feature (60)..(60): n = unknown
  misc_feature (66)..(66): n = unknown
  misc_feature (77)..(77): n = unknown
  misc_feature (209)..(210): n = unknown
  misc_feature (232)..(232): n = unknown
  misc_feature (250)..(250): n = unknown
  misc_feature (276)..(276): n = unknown
  misc_feature (278)..(278): n = unknown
  misc_feature (289)..(289): n = unknown
  misc_feature (359)..(359): n = unknown
  misc_feature (444)..(444): n = unknown
atgcaatgagtgcntttttcatgtgctcatccataaacagcggagcactttgatcccngncagttnttaaaaatganttctttgttttatttgtattttcaccatccactcctggatattcatctaagattgatgatacggggaattcactttctggtttaccagtattaattctatacattttggcaataatttgacgagcttcttcnnttcttccctgattcatcaaaantttgggactttctggtantttccacaaagcaaaacaacaaagcngngatggcaaacnacatgcaaccatatacaacctccagggcttgtatgtatatcccaaaaagtcaatatagaatgaccatttntgatttataattaaccatgcaaccgtcggtaatgcaagacacgcaaatccgaagatgcttgacgctcccataatagccctgctgngatgcctaggattatgaaattctctaaatatgcatatattggtgcacttccttc

SEQ ID NO: 2015 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagcttatgaaattacatgttctttttaataaa

SEQ ID NO: 2016 - DNA, 487 bp, Ctenocephalides felis
  misc_feature (59)..(59): n = unknown
attattacttttataaaaatataaatctatggatatctatataagggagaggtgtggtnaacctacatgattaaagtatcacttttatttaattaattagctattatgtataggtaattctatttagttttgtttaattaattaattactcagccttgcttattattatcgatttcgatacggaaagccaaatcctgcatcgagtcgtgctttagaagggacttcttttcgggatctttaacttttctgattggttttttgtttttaccatatctatttgtaacaccatcatcctcgtccatcatccttaaaatagttaattgatccgatgaatctaagggggccacagaaatatcacgaacggctctgaatttaccacaattattcaaatgttcgttttccaaacggaagaaattccatacaaacctcctaaacacttccaatggtgacagtatagatgtaagaatgtccccgctcacaaaattgt

SEQ ID NO: 2017 - DNA, 500 bp, Ctenocephalides felis
  misc_feature (66)..(66): n = unknown
  misc_feature (157)..(157): n = unknown
  misc_feature (396)..(396): n = unknown
  misc_feature (412)..(412): n = unknown
  misc_feature (415)..(415): n = unknown
  misc_feature (434)..(434): n = unknown
  misc_feature (438)..(438): n = unknown
  misc_feature (482)..(482): n = unknown
  misc_feature (487)..(487): n = unknown
  misc_feature (492)..(492): n = unknown
tttctttttttttttttttttttggacggcccaaacgatttatttttattaaaaggatacatgtantttcataaagcttctatatttatatattttaaataatcagaaattactatagttaatgacattttgtttgtgctccttacataaaatacanttttatacattttaatttttatacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgntttatttgccatttgntgntaaccaagaaacattggtnatantttttacaatctctttgatcgggaaaaacgctttacttttgggntgccntttgnacgagaaa

SEQ ID NO: 2018 - DNA, 500 bp, Ctenocephalides felis
  misc_feature (53)..(54): n = unknown
  misc_feature (56)..(56): n = unknown
  misc_feature (63)..(63): n = unknown
  misc_feature (70)..(70): n = unknown
  misc_feature (140)..(140): n = unknown
  misc_feature (183)..(183): n = unknown
  misc_feature (189)..(189): n = unknown
  misc_feature (191)..(191): n = unknown
  misc_feature (272)..(272): n = unknown
  misc_feature (372)..(372): n = unknown
  misc_feature (377)..(377): n = unknown
  misc_feature (379)..(379): n = unknown
  misc_feature (390)..(390): n = unknown
  misc_feature (398)..(398): n = unknown
  misc_feature (412)..(412): n = unknown
  misc_feature (415)..(415): n = unknown
  misc_feature (445)..(445): n = unknown
  misc_feature (453)..(453): n = unknown
  misc_feature (487)..(488): n = unknown
ttttttttttttttttttttttttttttttattaaaaagatacatgtaatttnngnaagcttntatattnatatattttaaataatcagaaattactatagttaatgacattttgtttgtgctccttacataaaatacanttttatacattttaatttttatacatattttttatatttaatngcacanancatttgtgtatttattatattaattgactactttatgataatttgaatcctaattagtctattcaagattgttttcctggnttaagccttacttagcaatctcacttttgcattcttcgccgggtggcgtgggtatgcatcgcaactccgttttatcaaagtgcaagccatttggacaatnataangntttatttgccntttgttgntaaccaaaaaacantgntaatattttttacaaactcttccaggcggnaaaaaccnttttcacttttgcatgcaaatctgcacgagaaannattttgggtaaa

SEQ ID NO: 2019 - DNA, 321 bp, Ctenocephalides felis
  misc_feature (25)..(25): n = unknown
ttctgacgatttctttttacacatntttttagaatgatcatatacatagttaggtgagcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2020 - DNA, 231 bp, Ctenocephalides felis
  misc_feature (27)..(27): n = unknown
  misc_feature (33)..(33): n = unknown
  misc_feature (50)..(50): n = unknown
  misc_feature (66)..(66): n = unknown
  misc_feature (83)..(84): n = unknown
  misc_feature (123)..(123): n = unknown
  misc_feature (207)..(207): n = unknown
aggtttcaaatgtccgtcaccatcganattttnttcaaatataaatgatngtcaaagctatggggnattgtgacgaaaatagnntacgaacccaatattattgccccgcaaattttgcatatnatccgttacgtcataattgcggacctatggctctgggcacaaaatgctatacagttacatgtcctgcacagcctaaggtgcttncgtacattggtgataaatcattgt

SEQ ID NO: 2021 - DNA, 145 bp, Ctenocephalides felis
  misc_feature (30)..(30): n = unknown
  misc_feature (59)..(59): n = unknown
tattaaataagtttggttgtctgttaaaangttttgagcaagcactgtttattttttantttaaataaatgcctattattgtttaaaaaaaaaaaaaaaaaaaaaaaaaaaaaataaaaaaaaaaaaaaaaaaaaaaaaaaaaaa

SEQ ID NO: 2022 - DNA, 319 bp, Ctenocephalides felis
  misc_feature (23)..(23): n = unknown
ctgacgatttctttttacacatntttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2023 - DNA, 313 bp, Ctenocephalides felis
  misc_feature (58)..(58): n = unknown
aattcttggctataagttcgttgcatgttttgcaagtgatttgtttattgcatttatngccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 2024 - DNA, 249 bp, Ctenocephalides felis
  misc_feature (56)..(57): n = unknown
  misc_feature (88)..(88): n = unknown
  misc_feature (235)..(235): n = unknown
ctgaatctgatggcgagccggatgatttaataacaactccaccaccttcacctccnntaaatgacgaggctgatagttccaagcgcanatcagctagaaacactcatcgtaagaaatacgtcgatgatgtaatgctacgattttcggatgaagacagtcctctagtggcgttggcttcaccagtaaaacaagaaaaagatgttaaaccaaaagagactgttgcaaaaaaaaaaanaaaaaaaaaaaaaa

SEQ ID NO: 2025 - DNA, 321 bp, Ctenocephalides felis
ttctgacgatttctttttacacatatttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2026 - DNA, 145 bp, Ctenocephalides felis
  misc_feature (29)..(29): n = unknown
  misc_feature (60)..(60): n = unknown
tattaaataagtttggttgtctgttaaantgttttgagcaagcactgtttattttttagntttaaataaatgcctattattgtttaaaaaaaaaaaaaaaaaaaaaaaaaaaaaataaaaaaaaaaaaaaaaaaaaaaaaaaaaa

SEQ ID NO: 2027 - DNA, 318 bp, Ctenocephalides felis
  misc_feature (22)..(22): n = unknown
tgacgatttctttttacacatntttttagaatgatcatatacatagttaggtgggcattcgaaaacctgacctttaccatctttgcagaataagtatcttgtgcagtctttcggatctggctgatatcctacaaccgcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagt

SEQ ID NO: 2028 - DNA, 410 bp, Ctenocephalides felis
  misc_feature (23)..(23): n = unknown
  misc_feature (55)..(56): n = unknown
  misc_feature (73)..(73): n = unknown
  misc_feature (118)..(118): n = unknown
  misc_feature (120)..(120): n = unknown
  misc_feature (124)..(124): n = unknown
  misc_feature (131)..(132): n = unknown
  misc_feature (134)..(134): n = unknown
  misc_feature (137)..(137): n = unknown
  misc_feature (168)..(168): n = unknown
  misc_feature (177)..(177): n = unknown
  misc_feature (327)..(327): n = unknown
ttttttttttttttttttttccntttgataacataaagcttctatatttatatgnnttaaataatcagaaatnactatagttaatgacattttgtttgtgctccttacataaaatacnantttntacattnnanttnttatacatattttttatatttaattgcacanatcatttgngtatttattatattaattgactactttatgataatttgaatcctaattagtctattcaagattgttttcctggtttaagccttacttagcaatctcacttttgcattcttcgccgggtggcgtgggtatgcatcgcaactccgttttatnaaagtgcaagccatttggacaatcataatgttttatttgccatttgttgttaaccaagaaacattgataatattttttacaat

SEQ ID NO: 2029 - DNA, 500 bp, Ctenocephalides felis
  misc_feature (30)..(30): n = unknown
  misc_feature (53)..(53): n = unknown
  misc_feature (118)..(119): n = unknown
  misc_feature (157)..(157): n = unknown
  misc_feature (161)..(161): n = unknown
  misc_feature (179)..(179): n = unknown
  misc_feature (194)..(194): n = unknown
  misc_feature (213)..(213): n = unknown
  misc_feature (233)..(233): n = unknown
  misc_feature (342)..(342): n = unknown
  misc_feature (364)..(364): n = unknown
  misc_feature (457)..(457): n = unknown
  misc_feature (486)..(486): n = unknown
tttttttttttttttttttttttttttttnataaagcttctatatttatatanggggaaataatcagaaattactatagttaatgacattttgtttgtgctccttacataaaatacanntttatacattttaatttttatacatattttttatattnaatngcacagatcatttgtgtntttattatattaatngactactttatgataattngaatcctaattagtctattnaagattgttttcctggtttaagccttacttagcaatctcacttttgcattcttcgccgggtggcgtgggtatgcatcgcaactccgttttatcaaagtgcaagccattnggacaatcataatgttttattngccatttgttgttaaccaagaaacattgataatattttttacaatctttttcgatcggaaaaaacgtttcacttttgcatgcagttctgcacnaaaaaagattttgggtcaaaccattcggnggacgtcgtcttca

SEQ ID NO: 2030 - DNA, 313 bp, Ctenocephalides felis
  misc_feature (31)..(31): n = unknown
  misc_feature (58)..(59): n = unknown
  misc_feature (200)..(200): n = unknown
ggttaaagaaagttgtgactcgactaacttngaaaaaatgtgttgcgagaaatcgggnngtaacgttcaaaaacttccagaactaagaaacgaatgtttcaaagatgcaggaaagacgaagaccaaagtttgtatgaatccaaaggacgactgctattcaaaaattgaaaaaggtgtcattactcgaggatgcaaatcanatcagggtaacgattgtaatgcaaactctgattcatgtaaaatatgccacgggaataaatgcaataaacaaatcacttgcaaaacatgcaacgaacttatagccaagaattgt

SEQ ID NO: 2031 - DNA, 386 bp, Ctenocephalides felis
  misc_feature (57)..(57): n = unknown
atatatcttacatcgaatctaataacattaaagagttattaattttcatgtcgatgntttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggt

SEQ ID NO: 2032 - DNA, 322 bp, Ctenocephalides felis
  misc_feature (28)..(28): n = unknown
  misc_feature (155)..(155): n = unknown
  misc_feature (254)..(254): n = unknown
  misc_feature (294)..(294): n = unknown
  misc_feature (305)..(305): n = unknown
gaatgaaaagaatcggccaaatgcatgnaaaaggttgcattaaatatacaactagcagcagccagagtttcaactgatgttggcattaaagtaggagaagccctcaggaatgtcgtggaacttcgtttagatttgggaaaatgttcttcagacantttgaataaatgggaatccagattggaagaaattaatgatgttgtggaaaattgcatcgtgtgaaattgtaacttgaaataatttttcttaactattanttttatagatgaacaaatacataatctaataaaccagcangtgaaaaaaanaaaaaaaaaagaaaaaa

SEQ ID NO: 2033 - DNA, 376 bp, Ctenocephalides felis
  misc_feature (29)..(29): n = unknown
  misc_feature (37)..(37): n = unknown
  misc_feature (40)..(40): n = unknown
  misc_feature (58)..(58): n = unknown
tgaaatgtgaagacgacgtcaacgaatgntttgaccnaanatctttctcgtgcagaantgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaaaaaa

SEQ ID NO: 2034 - DNA, 230 bp, Ctenocephalides felis
  misc_feature (38)..(38): n = unknown
  misc_feature (180)..(180): n = unknown
gccagggagaacgccgaagccctcagagcacaagccanggagtgcgttgttaccgcagccgatgtcgatgaagccagagcttgcttgaaagatgtccttcaagctgcccgtgaaggagccaaggacttggccaaggctttcaaagaaacctggtcccaattgggcaacttggttcgtgangtcggcaaatgcgcaagaggagccgtgaaggaattcagagataacttggt

SEQ ID NO: 2035 - DNA, 400 bp, Ctenocephalides felis
acatcaagcataattttcaaaaatggtccaagaaaccgaatgcaaattaaatggatcctcaaaccccgaggaaactaatgtgattcacggtccagccgcgcctgccaacgaaggtttgaggggctttggagaggaaatttatgacagaatagttttacatggcgatagagtatccatgatcgacggagacaccgatcgctccaccaccttcgacgcccttcgggcacgcagtgcagcaatcgctctagccctaagggctcgtggagtgaccaacaaagacgtcataactttggtagaactcaccacagaagactcttttgccattgttttggggataattttctcaggagccactttagggatgttggatggagcctggacagtcccaaacactgctagt

SEQ ID NO: 2036 - DNA, 377 bp, Ctenocephalides felis
  misc_feature (52)..(52): n = unknown
  misc_feature (57)..(57): n = unknown
  misc_feature (74)..(74): n = unknown
  misc_feature (104)..(104): n = unknown
  misc_feature (116)..(116): n = unknown
  misc_feature (136)..(136): n = unknown
  misc_feature (165)..(165): n = unknown
  misc_feature (173)..(173): n = unknown
  misc_feature (212)..(212): n = unknown
  misc_feature (224)..(224): n = unknown
  misc_feature (241)..(241): n = unknown
  misc_feature (272)..(272): n = unknown
  misc_feature (279)..(279): n = unknown
  misc_feature (366)..(366): n = unknown
ttttttttttttttttttttttttttttttttccgaaattgtttattgttgngggtnatacagttttatgattnaaagttttacattgtttttaataaactgtnggatttccgggnggctcaattttgtatatacnccaggatatccaggtcgcgcgcatcctcncctccagnatataactcctactaggaacctgtttttcatctacaagnggcccaccgctntccccatgacaagtatntttttgtccttgaggaaaaccagcgcacatnatactgncagaaatgatgtcactgttaatagcatgactgttcttgcattcttgacttgagtaagctttaactttaacttcttgaaactttggcnaaattggcccc

SEQ ID NO: 2037 - DNA, 387 bp, Ctenocephalides felis; identical to SEQ ID NO: 1086

SEQ ID NO: 2038 - DNA, 250 bp, Ctenocephalides felis
  misc_feature (23)..(23): n = unknown
  misc_feature (71)..(71): n = unknown
  misc_feature (134)..(134): n = unknown
  misc_feature (140)..(140): n = unknown
  misc_feature (164)..(164): n = unknown
  misc_feature (185)..(185): n = unknown
  misc_feature (200)..(200): n = unknown
aaccaaccaaggacacttctttngtggttccatcatcagcaatcgttggggtcttactgctgctacttgcntgttaaataaatatccaaatgatattcttctcgtcgttggaaccaacactttgaatgctggcngagtangatacaaagttgcccaaataatcnttcataaccaatttaacccanaacacataccacaantaacatcgctttgctaaaaactacatcaaatattgtatacacaaactatg

SEQ ID NO: 2039 - DNA, 500 bp, Ctenocephalides felis
  misc_feature (60)..(60): n = unknown
gttcttcagatatttactaaatattgtgaaataaatcattttcaaaatggtgtccaaagngtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgccaaaatggcttggccgcctggagagaagccagggagaacgccgaagccctcagagcacaagccaaggagt

SEQ ID NO: 2040 - DNA, 500 bp, Ctenocephalides felis
  misc_feature (60)..(60): n = unknown
gttcttcagatatttactaaatattgtgaaataaatcattttcaaaatggtgtccaaagngtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgccaaaatggcttggccgcctggagagaagccagggagaacgcccgaagccctcagagcacaagccaaggga

SEQ ID NO: 2041 - DNA, 500 bp, Ctenocephalides felis
  misc_feature (60)..(60): n = unknown
gttcttcagatatttactaaatattgtgaaataaatcattttcaaaatggtgtccaaagngtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgccaaaatggcttgcccgcctggagagaagccagggagaacgcccgaaaccctcagagcacaagcccaaggg

SEQ ID NO: 2042 - DNA, 420 bp, Ctenocephalides felis
  misc_feature (12)..(12): n = unknown
  misc_feature (322)..(322): n = unknown
  misc_feature (329)..(329): n = unknown
  misc_feature (350)..(350): n = unknown
  misc_feature (382)..(382): n = unknown
  misc_feature (409)..(409): n = unknown
aacaaaatcctncaattgatttttcatctatatcaaaaaaattaggtgaactttgggcaaatgtgcctaatggagagaagtataattggcgtcgaagggctaaacgtatggctatgaaagtagcgagagatgaacaaataaaaacatctgataataaagcacaatttataaataaaagcaaatctaataagccctcccaattctccacttcaccaacagtttctaagaaacttgatatagaagatttataagtgatgcctaattcccaacaaaattctgataatttaatgttgagccccaaatcatcaagcaatgagcagcngtttatnttttaaggcctgtataaagtnacaggaagtttccccaattggacatagctgcnttatctaaaagttacctttggccgagnagttgaatatt

SEQ ID NO: 2043 - DNA, 199 bp, Ctenocephalides felis
aattgattttagagcattcaaatcggatgctctgttctctcaaaaacttaatttttattttctgcactctttgcttcgtatcttcgaaatagctggatcggcctttgccaaaaactaatcagcacatctccctatcaataggaatcgaatttttttttgaaccattcaaattggttgatccgtgcgtccgaaaacgtgt

SEQ ID NO: 2044 - DNA, 498 bp, Ctenocephalides felis
  misc_feature (449)..(449): n = unknown
  misc_feature (452)..(452): n = unknown
aaatgtcaaaacaacggtgttagataacagacttaaaatatccttattggttttgaacaaaaattaaatactacaaaatatgcataattgtatgaaccttctacaagaaccaagaaacttatacacttttatacaaaaatttggaaattttactcaaaaactaagaaaaatgtcctaagtggaagaaacttttacttatgaaattatatataaacctcaacacacttctgttgttgtttttaagatttttaaaaaaatatttttattgttttggaacaaaaattaaatactacaaaatatgcataatttcatcaactttctataagaaccaagtaacttatacacctttatacaaaattttggaaattttattcaaaaaccaaaaaaaatgtcctttaacaaacttttacttatgaaattatatataaaactcaacctactactattgntgntttcaagattttttttaaaaatctcttattgattttgaaccaaaat

SEQ ID NO: 2045 - DNA, 534 bp, Ctenocephalides felis
gctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggttaagccaggtggttctatccttaatttttaaaattaattagtcgaaaggccattaattataataattatttaattgaataaaataaaaaaaaaaaaaaaaaaaaaaaaa

SEQ ID NO: 2046 - DNA, 545 bp, Ctenocephalides felis
taatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgttcgccattaattcttacatgatctgagttcaaaccggttaagccaggtggttctatccttaattttttaaaattaattagtacgaaaggccttaattataataattatttaattgaataaataaaaaaaaaaaaaa

SEQ ID NO: 2047 - DNA, 469 bp, Ctenocephalides felis
agagagtctgtttggcacgaagttgcttaaagccttcagtggacgctgaaacaattaaaattattctagtcaaatattacattggtagtttaaagcctcgtgtgtgcttgaagacaaaaagtgcctttgtacaaaaacaaacagtgatatttaatttatgaaatcgttataaacgtgtgtcgtatgatacttggatatttataaaaaaaagtgatacttgttagtcagtttaaaccctatatgcacaaagggatataataagacatagttaaaattattgcaaaaatggttggaagtaacggtacaatgatggcaatacgtgttgttcgcagtaaactgaggaaacgcgaagagcactctaactctgttcatccagaggcgccccagacaattacggcggttgtaccacctgctgagccagtggcgtacaggcaacaacccatctggtgttcccgccgaacccgccgca

SEQ ID NO: 2048 - DNA, 549 bp, Ctenocephalides felis
aaaaaatgatacctattttttgtataaattctcaaatattgttagatttgtaatatttacaacaaaattcagtttttacatgctaaaaaacaaggtaacaatttagaattcataaaatataatgtaataataatttttttaaagtttatgaagttttataaaaaattcaatcaagatttctattctatttatacatctatttttatattaaaaacagatactcaaactaaataatgtaaaactgaatgtcactttctataacttttgttaaaaataattagaacaaaacttttatttcggttactatttcattgtcatattattttatataattattcatacaaaattatttgttgtaaattattttgtaatgaaaattgtataaactatttaaaaacacatcactaaataactatatatatatgatatatagatttatagatataattatctacacaaatataaatttagtaataaataaatttcatatattttatccaatgggttggtactgaaatgtaattaaataattatatttaattatatata

SEQ ID NO: 2049 - DNA, 538 bp, Ctenocephalides felis
atttattgtatcttgtgtatcagagttaatttaataaaagatatgaagaatatttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgtaggttatttaaggattcggcaaatataatattccctgttaacaaaactgcttttgaaatatataaagctaatct

SEQ ID NO: 2050 - DNA, 513 bp, Ctenocephalides felis
gaattattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaacttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtcgaaaggccattaatttataataattattttaatttgaataaaattaaaaaaaaaaaaaaaaa

SEQ ID NO: 2051 - DNA, 289 bp, Ctenocephalides felis
cctggtcccaattgggcaacttagtccgtgaagtcggaaaatgcgcaaggggagccttgaaagaatttagggacaacttagtacaagtccgtaaagactgtgccgactgcttaaaacttactgataactaaattagtttaagaattgtataacaaactgtaaacttcctaaaaatgtctagtgatatattatttgtggtctaatggttctagcttatgtagctttttgacaaataaaaattgtttataaaaaaaaaaaaaaaaaaaaaaaaaaaaaaaaaaaaaaaaaa

SEQ ID NO: 2052 - DNA, 459 bp, Ctenocephalides felis
  misc_feature (5)..(5): n = unknown
cacanataatatatcactagacatttttaggaagtttacagtttgttatacaattcttaaactaatttagttatcagtaagttttaagcagtcggcacagtctttacggacttgtactaagttgtccctaaattctttcaaggctccccttgcgcattttccgacttcacggactaagttgcccaattgggaccaggtttctttgagtgccttggccaagtcttttgctccttcgtgggcagcttggagaacccctttcaagcaaactctggcttcatcgacatcggctgcggtcacaacgcattccttggcttgtgctctgagggcttcggcgttctccctggcttctctccaggcggccaagccattttggcgaacttggttgaattcatcacgtttgtcatctctgcaagccttgacttagcacggcttcttgtgcgtagcctagagctttttggt

SEQ ID NO: 2053 - DNA, 546 bp, Ctenocephalides felis
  misc_feature (33)..(34): n = unknown
gttttttaattgaaagctggaatgaatgattgnntgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccaataattcttacatgatctgagttcaaaccggtttaagccaggtggttctatccttaattttttaaaattaattagtcgaaaggccattaattataataattattttaatttgaataaaataaaaaaaaaaaaaaaaaa

SEQ ID NO: 2054 - DNA, 549 bp, Ctenocephalides felis
atcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcgctggtttggccgtaggattttccggcttggcggcgggttttgcgattggaatcgttggtgatgctggagtacgaggaacagcccaacaacctcgtctgttgtggaatgatcttgatcctgatcttcgctgaagtattgggtctatatggcttatcgagccatctacctctacaccaaataaacaaatattatggatttcaagatc

SEQ ID NO: 2055 - DNA, 549 bp, Ctenocephalides felis
  misc_feature (496)..(496): n = unknown
gttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggagccacatcattgtgcttcgtctacccacttgatttcgccgaccagatggccgtgatgtagtnaagcgctggcaacgtgaatcttggatggcaactgttgaccaaatctcaatctg

SEQ ID NO: 2056 - DNA, 538 bp, Ctenocephalides felis
tttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggtttatttaaggaattcggcaaatataatattcacctgtttaacaaaaacatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaatggtatagaattaattttatgtaaaagc

SEQ ID NO: 2057 - DNA, 549 bp, Ctenocephalides felis
gccggaatacgtttgccgacacgcccgtacaacaaaaatgagttctttgaccttatatcattttgcaccaagttttccgtcacgagcagcgctgttaactattagagcactaaatcttaaggttgatataaaagaagtaaatctgtttgctaaagaacaatttaaaccagaatttttgaagattaacccacaacattgtgttccaacattagatgacaatggtttcgttctttgggaaagtcgggctatagctacttacttggtccaggcttatgggggtgaaaaatatagttccttgtatcctcaagctgctaaagaaaaagcagttgttgatcagagattatactttgatgctggagttttatttcctagaattcgagccatttgctttcctattctatttttgggagaaactacgatttcacaagacaaaaaagaccaactaaatgaagcatttggtatctagacggtttcttgcaaacaaagtgggtagctggagacaactttccgagcagataatgcattctggcttgttctagcatcaagctg

SEQ ID NO: 2058 - DNA, 500 bp, Ctenocephalides felis
aattatttaaggttaagttaatttgcaacgtcttaagcactattattttgataaaaatgaatgaaaagtcagaaaatccatttcaaacccaatctgatttcaattaccttcctcttcttgttggaataactgtagttttcgtcacattaattttattccttctgtggcaaagaagaaaaggtgctcgaagggatatattgataactggacttagcgatgctgggaaaactttgttgtattcacagctggtccattcacagtcaaaagatactcatacttcaattgctgttaatgtcgatgaatacatcacaaagaatgcgtcagtaagagttgtggatattcctggacatgaaagattacgtggaagattttttgatgattcaaagattcagcacgaggtattgtgtttgttgttgattccaccactttgcataaagacattcgtgatgtagctgagtacttgacacgatctttctgataaatcagtacttctaatgctc

SEQ ID NO: 2059 - DNA, 545 bp, Ctenocephalides felis
attctctttggatcttgatcatgttaaagttgctttaacggcattggctcgtatgcatgcaagttgcattatctacgagaagaaaaaaaattgttgcatggggagagtttacaaagatcttatgttcgagactatggccaataataatcaatggtggaggactggagaggatactgctttagcaattgctgaggaatctgagaaattcggtaaatataccgaataccattccatggtacaggagaagttaattgatttcctgagattggcatggtctatggtaaaaccatcgcgcatttataaaaatgtggtatgccaccgcgatacgcgcaatcacaatttgatgttcaaatataattcaactggtctacctgaacaatgcatcttggtcgatttccaaagatgcacctacaatccaccagctttggatttcaatcatcttctatatcagacaacatctagaagctttagagaccagcactccaggaattgaagaggtctacagagcagcatttgagaaaacattcgaaggaaaatttggatgt

SEQ ID NO: 2060 - DNA, 501 bp, Ctenocephalides felis
  misc_feature (471)..(471): n = unknown
cttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttcatgatctgagttcaaaccggtttaagccaggttggtttctatccttaattttttaaaattaattagtcgaaaggccattaatttataataattatttaattngaataaaattaaaaaaaaaaaaaaaaaaaa

SEQ ID NO: 2061 - DNA, 496 bp, Ctenocephalides felis
gaccattctgctgaactgtgtctagcaggccatttttgacagtgggttcgctagtttagtgaagtgagtgtgtgaagatacttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcctggtttgccgaggattttccggcttgcggcggttttgcgattggaatcgtggtgatgctggagtcca

SEQ ID NO: 2062 - DNA, 549 bp, Ctenocephalides felis
  misc_feature (510)..(510): n = unknown
gtctccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgctgcagtctctaagactgtggtagcacccatcgaacgtgtcaaattgctcctgcaagtacaacacatttccaaacaaattgctgaagataaacgttacaaaggtatcatcgattgctttgtacgtatccctaaggagcagggcgtactttccttctggcgtggtaacttggccaatgtcattcgttatttcccaactcaggctttgaactttgcattcaaagacaagtacaagcaagttttcttgggtggagttgacaagaagacccaattctggcgttacttcgcaggaaacttggcatctggtggtgctgtggaccacatcattgtgcttcgtctacccacttgattttnccgtccagatggccgtgatgaagtaaaggcctgtcaacg

SEQ ID NO: 2063 - DNA, 549 bp, Ctenocephalides felis
agaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggaccacatcattgtgcttcgctacccacttgatttcgccgtccagatggccgtgatgtaggtaagcctggcaacgtgaatctt

SEQ ID NO: 2064 - DNA, 549 bp, Ctenocephalides felis
  misc_feature (490)..(490): n = unknown
  misc_feature (522)..(522): n = unknown
cgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggtttatttaaggaattcggcaaatataatattccctgtttaacaaaaacatgctttttgaaaataatataaagtctaatctnccatgaagattaaaagccgcgtaatttgctgngcaaggagcatatcaatagtttttaat

SEQ ID NO: 2065 - DNA, 502 bp, Ctenocephalides felis
tttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggtttatttaaggaattcggcaaatataatattccctgttaacaaaaacatgtctttttgaaaataatataaagtctaatctgccatg

SEQ ID NO: 2066 - DNA, 496 bp, Ctenocephalides felis; identical to SEQ ID NO: 2061

SEQ ID NO: 2067 - DNA, 549 bp, Ctenocephalides felis; identical to SEQ ID NO: 2062
  misc_feature (510)..(510): n = unknown

SEQ ID NO: 2068 - DNA, 549 bp, Ctenocephalides felis; identical to SEQ ID NO: 2063

SEQ ID NO: 2069 - DNA, 549 bp, Ctenocephalides felis; identical to SEQ ID NO: 2064
  misc_feature (490)..(490): n = unknown
  misc_feature (522)..(522): n = unknown

SEQ ID NO: 2070 - DNA, 502 bp, Ctenocephalides felis; identical to SEQ ID NO: 2065

SEQ ID NO: 2071 - DNA, 546 bp, Ctenocephalides felis
  misc_feature (24)..(24): n = unknown
  misc_feature (40)..(40): n = unknown
  misc_feature (83)..(83): n = unknown
tatggttcattacacagaattcgngcaaagaacactgttntggcgactggtggttatggacgagcatatttttcatgcacttnagcacatacctgcacaggtgatggcaccggtatggtagccagagctggattaccagcacaagatttagaatttgtgcagttccatcctacaggtatttatggagctggctgtttaattactgaaggatgcagaggtgaaggtggatttttggtaaattctcaaggagagagatttatggaacgatatgcacctgttgcaaaagatttggccagtagagatgtggtttctagatcaatgacaattgaaatcaatgaaggtcgcggtgtaggacctgagaaagatcatgttttattgcaattacatcacttaccagctgaacaattagcgagcagacttcctggtatttctgagacagctatgatattttgtggtgtgatgttactcgtgagccaatcccgtttaccacagtgcattatatatgggaggagtaccccaaatacaaggacagtcttaatatgtgtg

SEQ ID NO: 2072 - DNA, 541 bp, Ctenocephalides felis
attttcaaaatggtgtccaaagtgtttgttgctcttgccatcattggctttattggggctgcccaagcctttttcgatcaagatgctgtcttagataagatggtagatgacatttctgctgaatatgaaaacagcattgcaagaattagccaagacagcaaaattgatatgattgctgcagaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggctacgcacaagaagcccgtgctaaggtcaaagcttgcagggatgataaacgtgatgaattcaaccaagttcgccaaaatggcttgccgctggagagaagccagggagaacgccgaagccctcagagcacaagccaaggagtgcgtgtgaccgccgccgtgtcatgaaccagagcttgttgaagagtcctccagctgccgcgaagactaagacttggcaagg

SEQ ID NO: 2073 - DNA, 482 bp, Ctenocephalides felis
cttaaccttacgaatacttagattttctttaagaaaatcttctatctaagaagaaagcaaattcaagttgatgcattattctccggaattgttagagaatctgaacaacggttcgttgttcttcagctacgaatacaaccggcactgtaaagggtctttgaagaaactggctcggaagctgctccacgttaggacggccgtgctgaagattgggaacaagtaaagattaccaggaaagggaaacgatgatgaccaggaacagaattataccgcatcttagccaacgtcttcggacatcatgtcaacatcattcatcacaaatatcatcgcagtttaggtagtaatagttaacactttaggataggaaataagcttaaagaagggaacaagaccatgatcttggaataactgttttctgattttcgtaattgaaaataaaagaaatactgaaggggtacatgttcctgtaccatcaaaatatg

SEQ ID NO: 2074 - DNA, 508 bp, Ctenocephalides felis
  misc_feature (16)..(16): n = unknown
  misc_feature (28)..(28): n = unknown
  misc_feature (32)..(32): n = unknown
  misc_feature (121)..(121): n = unknown
  misc_feature (197)..(197): n = unknown
  misc_feature (321)..(321): n = unknown
  misc_feature (456)..(456): n = unknown
tcattttcaaaatggngtccaaagtgtnggtngctcttgccatcattggctttataggggctgcacaagcctttttcgaacaagatgccgtcttagataagatggtagatgacatctctgntgaatatgagaacagcattgcaagaattagccaagatagcaaaattgatatgattgccgctgaattcgaaaaacanggatttgcccctgaagtcgatagagatttggagaggttcaacaaagaagttgaaaggaaacttagcaaaaaagtgagtgaagccgcaaaggaatgccttaaaggccaacaccaaaaagctctangctacgcacaagaagcccgtgctaaggtcaaggcttgcagagatgacaaacgtgatgaattcaaccaagttcgcaaaatggcttgccgctggagagaaccagggagaacgccgaagccctcagagcacaagccanggagtgcgttgtgaccgagcgtgtcgatgaaccagagtttgcttgaaggggt

SEQ ID NO: 2075 - DNA, 404 bp, Ctenocephalides felis
  misc_feature (355)..(355): n = unknown
  misc_feature (358)..(358): n = unknown
gaattcaaaaccaaattcggaagagataaaccaacattcgatactgaaatcatttttagttgccgttccggaaaacgagcaaaggaagctatggaaacagcattgggattgtgttacaagaaatcaagatactacgaaggtagctttttagaatggagcagcaagcagaagaaacagtgaaattgcagggttaatcaaatattttatatgatacacatattatttacagatatgatcaaactaagtattacttgcgtgtgttatattagcatattaatattttcttatgaaatgttcttaagatgattttaaatattgttaaataaaatttgtatactttttagatatgcaccanatnaattaaaataaaaatctttacattcctaaaaaaaaaaaaaaaaaaa

SEQ ID NO: 2076 - DNA, 549 bp, Ctenocephalides felis
  misc_feature (538)..(538): n = unknown
ctccttttgcgaaggttgaaatattttaattcgtgatatttcaccaagtgactaaaatgaaagctgtaatatttttggtggccatctcgattgtccaatgggcaaactgtgattaccatccaccaccttacgcattttctcagtacagaccaggatattcttctgtgggccaatattataagcctgagatttttggaccaaatgcaatcagtaccaacaatagtcatcactttcaagtaggatacccaagttatggaaacgttttgctgtaccgtcaagtccaatccaagagtggaaactttttcaggaaagctactagagaggtgtcatttccaccagtgggatcgagaaataatcgcacaattagctgtgttcgtgccctggaccaatatgtaaatggcaaggaggctatgccactcttgtcaatggtggagttggctggaaaaatgtaactttactcctatcttctcagactggcaaaggatttaacttttagtgaaatttggggatttagattagaaattaatgaaatgtgatntgaaaaaaatt

SEQ ID NO: 2077 - DNA, 549 bp, Ctenocephalides felis
atttactaaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagacgccgaaccctcagagcacaagccaaggagtgcgttgtaccgcaccgtgtcgatgaaccagacttgttgaagatgtccttcagctgccgtgaaga

SEQ ID NO: 2078 - DNA, 470 bp, Ctenocephalides felis
  misc_feature (21)..(21): n = unknown
  misc_feature (59)..(59): n = unknown
  misc_feature (65)..(65): n = unknown
  misc_feature (86)..(86): n = unknown
atagaatttaatttttatgtnaaaaagcgtaaatattattaaaggacgagaagaccctntaaagntttatatataaatatagattnattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgttcgaccattaattcttacatgatctgagttcaaaccggttaagccaggttggttctatccttaatttttaaaattaattagtacgaaaggccttaatttatataattattttaattgaataaataaaaaaaaaa

SEQ ID NO: 2079 - DNA, 508 bp, Ctenocephalides felis
  misc_feature (156)..(156): n = unknown
  misc_feature (363)..(363): n = unknown
  misc_feature (449)..(449): n = unknown
accaccccagtattcaaatactgtcactgtcagcgttagaccaccgcctccacctgtgccaattagaacatcaacaaaccctgattatcatcggaatacaatttctcatgatgaaatggatgcagggcataggtctcaaccaaacagcctttcagnaaatggatcacatgctaatgacagtctgcgaaggcatactggtgaatatgcatacacttcaggttgggggcctagtcgtttagatggaggtcgtgcgactttgttgcatttgtctgacacaagagaaacttcagatacaccaaatggtagtgacaataccacaccaaatgccataaaaaataatagaaggaatggcatgttcaattntcttcgtcctaataaatacaggcgccaatctaacacataatgaatcaccaaggtaatggaagaattagcatgccaaataaaactcnttaataagtggatgttatgttaaagaattaattaagaatatatttcaagtataccaaaa

SEQ ID NO: 2080 - DNA, 549 bp, Ctenocephalides felis
cttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcgctggtttggccgtaggattttccggcttggcggcgggttttgcgattggaatcgtggtgatgctggagtacgaggaacagcccacaacctcgtctgttgtggaatgatcttgatcctgatcttcgctgaagtattgggtctatatggcttatcgaaccatctaccttacaccaaataaacaaattattatggatttaaga

SEQ ID NO: 2081 - DNA, 515 bp, Ctenocephalides felis
ctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggtttatttaaggaattcggcaaatataatattccctgttaacaaaactgtcttttgaaataatataagtctaatctgcccatggagattaaaaggcgcagaattg

SEQ ID NO: 2082 - DNA, 549 bp, Ctenocephalides felis
ttaacgttattcgccataatgaagttgttggtgttattcgcaactctagccgtaggcctatgcctaggtgaaaaagttatattcaataactataaagtttatagagtaattgctgacaacttcgaacaagttgaggttctgaagaatttggaaaaggactctgatgcgtacaatttctggacccatgttggagccccaggcaaaaatgtagacatcatggtacccccacacaaacttgaggatttcgaaagcacgatgcaataccatagaataaaccacagtgtaatgagcgatgacgtccagaaagatatcgacctagaagtttttggtacaagtagagaagcttacagttggaccaagtatcaagatcttgaaacaacctatgcatggatggacagcttaccaaggcacacccaggaaaagtcactgttctcaccattggcaaaacttttgagggaagagacatcaagggagtcaagatttcattcggactgcaaccaggcgtattattgcgctggatcacgcccgcgatggtccactgcactgcct

SEQ ID NO: 2083 - DNA, 548 bp, Ctenocephalides felis
  misc_feature (101)..(101): n = unknown
  misc_feature (123)..(123): n = unknown
taattgaaagctggaatgaatgattgaatgaaatattaactgtcttaataaaattgttatagaatttaatttttatgttaaaaagcgtaaatattattaanggacgagaagaccctttaaagntttatatataaatatagattaattttaagaatattattaaatttatttatattaatatattttattggggtgataggaaaatttataaaactttttttttattaaaacataaataattgaataattgatctataaattatgattaaaagattaagttacttaagggataacagcgtaattatttttaagagaacatatcgacaaaatagattgcgacctcgatgttggattaagataattttaaaatgcagaagttttaaaatttggtctgttcgccattaattcttacatgatctgagttcaaaccggtttaagccaggtggttctatccttaattttttaaaattaattagtacgaaaggccattaatttataataattattttaattgaataaaataaaaaaaaaaaaaaaaaaaaaaaaaa

SEQ ID NO: 2084 - DNA, 549 bp, Ctenocephalides felis
attaatacgttgcaccgtagctctaaagtgacgttacaatgtcgggaggcttggatgttcttgccctacgggaagatgatgttaccaaaatgttagccgcatgcacccatcttggcagcgaaaatgtgaacttccagatggagcaatatgtgtacaaacgccgtgctgatggagtacatgtaatcaacttacgtcgcacatgggagaagcttttgttggctgctcgtgctattgttgctattgagcatccagctgatgtcttcgttatttcctccagacctcaaggacaacgtgcagtattgaagttcgccaactatactggtgctactccaattgctggacgtttcactcctggtgccttcactaatcagattcaagctgcattccgtgaaccacgtttgctgttgtactgatcctcactccgatcaccaacccatcactgaggcttcatatgtgaacattctgtattgcattcaccacactgattctccattgaaatttgtgtattgaattcatgcaacacaagtccaaccatcccgtgggttgatg

SEQ ID NO: 2085 - DNA, 549 bp, Ctenocephalides felis
  misc_feature (406)..(406): n = unknown
attttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgccaaaatggcttgncgctggagagaagccagggagaacgccgaagccctcagagcacaagccaaggatgcgttgtgaccgcagccgtgtcgatgaaccagagtttgcttgaaagggttctcaagctgccacgaaggacaaaagacttggcaagcctc

SEQ ID NO: 2086 - DNA, 511 bp, Ctenocephalides felis
tccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgctgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaactttgcattcaaagacaagtacaagcaaattttcttgggtggagttgacaagaagacccaattctggcgttacttcgcaggaaacttggcatctggtggtgctgctggagccacatcattgtgcttcgtctacccacttgattcgccg

SEQ ID NO: 2087 - DNA, 550 bp, Ctenocephalides felis
aataaaacaatttaaaaacgaaaatggtctcgacgaaattgtgtttgcaatttttgattgttgcatttgtcggatatacgacgagtgcccaacaatacacatgtctaaccgatggcgaaaaagaaaccacaacatgcaaactcatcaacgaatgttacgtaatttacaacacaaagtcaggaaccaccaactacggttgcctaatcaagatgacgaattcccaaagaaactactgtgccaaaaatccacacatgtgcataacttgcactggaaataattgcaataccaaagatttgatgaaaatgtgcatcacttgcacctccaaggaggacgagagatgcaccaccgatcctcagcaattggctaaaacttctgtcaggccttgcaatggtgattgcattacacatgtccttccagatggtacaaatacaaggggttgtatgaaaccaactgatgctgtgatgatatgaaatgccaggagtgcaaaggtaacctttgtatgcgtgttttcccaagaaatcgcagggttgaacgctaaagatgatgcaag

SEQ ID NO: 2088 - DNA, 228 bp, Ctenocephalides felis
gactgtgctgactgcttaaaacttactgataactaaattagtttagtaattttataacaaactgtaaattgcttaaaattgctttatgaccagctagttgtatattatttgtttttgatggttttagtttttttatgtaacattttgacaaataaaaattgcttataaaaataaaaaaaaaaaaaaaaaaaaaaaaaaaaaaaaaaaaaaaaaaaaaaaaaaaaaaaa

SEQ ID NO: 2089 - DNA, 529 bp, Ctenocephalides felis
  misc_feature (23)..(23): n = unknown
  misc_feature (29)..(29): n = unknown
  misc_feature (50)..(50): n = unknown
  misc_feature (118)..(118): n = unknown
  misc_feature (121)..(121): n = unknown
  misc_feature (138)..(138): n = unknown
  misc_feature (143)..(143): n = unknown
tcattttcaaaatggtgtccaangtgttngtcgttcttgccatcattggntttattggggctgcccaagccttcttcgatcaagatgccgtcttagataagatggtagatgacatctntgntgaatatgaaaacagcnttgcnagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaagccctcagagcacaagccaaggagtgcgttgtccgcaccgtgtcgataagccagacttgcttgaagatgtcttcagctgccgtgaagacca

SEQ ID NO: 2090 - DNA, 550 bp, Ctenocephalides felis
  misc_feature (68)..(68): n = unknown
attaagtgtattaaattctccaaatggagtccaattccaaggcgagactcctttaccacaatcattgntaaaggaattgtattccgtagccctaggattgacatcggagcagagttctgccgaatgggacggagtgagtaaattaaatccttttcaattacctaaagctgtagtcactgtagttgtagaaggcacagataaacttagtttggactcgaagaacacttatcctttggttgtggatgaggaattggataacacttgggactccttagataaacgcttcaaagaacgttatcccttcgatgatttgactcttgtgaacttggaattacctaatggtaacgttaattctgagcgtgtctttggtgttgtatcacccaaaccggtcaaagtgatttaccagagaagtttgtgaaagacttgggtgtctcaacgctttatctgcaaagtttggactaaccctgatgagcgccctacctgtcttcttccgttatcacaattcaatccccgaaacccgccaagccaaacagactaccaagcctcaaac

SEQ ID NO: 2091 - DNA, 484 bp, Ctenocephalides felis
tagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtcgaaaggccattaatttataataattattttaatttgataaaattaaaaaaaaaaaaaaaaaa

SEQ ID NO: 2092 - DNA, 533 bp, Ctenocephalides felis
aaaacagataaaaaatacataagcgatgtgtaagcaaagaaattataaaaaaaataaaaaggaaatgtgtttaatacacacagaaagacgtttggaagtatgacatttttaaatattatacaatatatataaaaactatcttataattataatataactatcttataatagtttggtgtaaacgtataagaataatcattaggttgtattcacaaactaaaacttgatacaaacaactaatcatgaaataatacttattgctaaatatgtgaatatccaccttaaatctatattaataatcatatataataacaatattaataatatatttatcaatctttaatcgataacccaaccatatatatatttattcgaaagcatgcaatatgtgtatattaacattaataagaagaacgttgtaataatatgaatattatgatattattataataataaattataaagtatatttatcaatataataataatgttagcttagcttgctgtactgaaacttattcgaaaataatgca

SEQ ID NO: 2093 - DNA, 426 bp, Ctenocephalides felis
  misc_feature (343)..(343): n = unknown
  misc_feature (380)..(380): n = unknown
cagatatttactaaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggtcaacaaagaagttgaaaggaacttaacaaaaaagtgagtgaagccgcaaaggaatgccttaaaggccacaccaaaagctntaggtttgcacaaaaagctcgtctaggcaggcttgcnggattataacgtgagaatcacccagtcgccaaatgcttgccgctga

SEQ ID NO: 2094 - DNA, 519 bp, Ctenocephalides felis
  misc_feature (65)..(65): n = unknown
  misc_feature (377)..(377): n = unknown
ggcagaagttacgtaagcacactccaaaaaatactatcagtgctcataaaggatttaatattctncgtacagtagcttacaggtgagatcaatttaattcaactcaactggctatacattttattacaagatgcactccgtaatcaattccactttgcgaaccctgagcaaaacagaatcgggtaaaatcgcatcgattttatcgaacagcaggagttatgctgccaaagcagcagcaggtgcccaaggcaaagttgttgccgttatcggtgctgttgtagatgtacaattcgaagatagcttacctcccatcctaaatgctcttgaagtatccaacagaaagccaaggctcgtccttgaagtagcccagcatttangagaaaataccgtccgtacaattgctatggatggtaccgagggtttggtacgtggtcaaggtgttgttgactgcggatcacccatcaggatccccgtgggagctggacattggcaggatcatgaacgtatcggagaaccaat

SEQ ID NO: 2095 - DNA, 550 bp, Ctenocephalides felis
ctgctcgatttttgtgtcaatttgcagttttagtagttattttatttagaaatttgttataaatcaaatcagcaaccatggctttaagcgatgccgatgtacaaaaacaaatcaagcacatgatggctttcattgagcaagaagccaatgaaaaagctgaggaaattgacgcaaaagcagaagaggaattcaacattgaaaagggacgattggtacagcaacagcgactaaagattatggaatactatgagaagaaggaaaaacaagttgaattgcaaaagaaaattcaatcatccaacatgctcaaccaagctcgattgaaggtattgaaagttcgtgaagatcatgtgaggaatgttttggatgaagcccgcaaaaggttgggagaagttacacgtaataaggaacaatacaaagaagttttaacaacacttattgtcaaggaatgttccagcttatggagcccaaagtattattgaggccgcaaagctgatttagattggtagatagtttactgtgccatggtcagtataaacacaatggtaccaaa

SEQ ID NO: 2096 - DNA, 550 bp, Ctenocephalides felis
aattcggcccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgctgcagtctctaagactgtggtggcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgctggagccacatcattgtgcttcgtctacccacttgatttcgccgtaccagattgccgtgatgaggtaaaggcgctggcaa

SEQ ID NO: 2097 - DNA, 550 bp, Ctenocephalides felis
gtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaagccctcagagcacaagccaaggatgcgtgtaccgcaccgtgtcgatgaaccagacttgcttgaaagatgtccttcaagctgccgtgaaggaccaggcttggc

SEQ ID NO: 2098 - DNA, 550 bp, Ctenocephalides felis
gtgaattcgttttgccgggtcgtagtaaccaatttaatataatggctcctccaccatacgcagacttggggaaacaagctagggaggtatttaacagtggctatcattttggtcttttcaaattgaatttgaaaactaaaactgcctctggggttgaattcacttcaggaggaacttctgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgcttcttacatgatagtgttgcagtaaatgctgatgtaaatttgaatttatcaggacctttgatcaatgccagcgcagtagttggtatcaaggtggttggccggttatcaaactggatttactctgaaaattcaaggcacaaagacacttgccttgatctcaca

SEQ ID NO: 2099 - DNA, 427 bp, Ctenocephalides felis
  misc_feature (41)..(41): n = unknown
atcgggtcgagtttgcaaaagagttttatttaatttattgntgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgca

SEQ ID NO: 2100 - DNA, 548 bp, Ctenocephalides felis
  misc_feature (417)..(417): n = unknown
gtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgcaaaatggcttgncgctggagagaagccagggagaacgccgaagccctcagagcacaagccaaggagtgcgtgtccgcaccgtgtcgatgaaccagacttgttgaaagatgtccttcaagctgccgtgaagaccaggcttgcca

SEQ ID NO: 2101 - DNA, 525 bp, Ctenocephalides felis
gttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgttcgaccattaattcttcatgatctgagttcaaaccggttaagccaggtggttctatccttaatttttaaaattaattagtacgaaaggccattaattataataattatttaatttgataaaatta

SEQ ID NO: 2102 - DNA, 524 bp, Ctenocephalides felis
  misc_feature (112)..(112): n = unknown
atttaaaaggccgcagtaatttgactgtgcaaaggtagcataatcaatagttttttaattgaaagctggaatgaatgattgaatgaaatattaactgtcttaataaaattgntatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgtcgccttaattcttacatgatctgagtcaaaccggttaagccaggtggttctatccttaatttttaaaattatagt

SEQ ID NO: 2103 - DNA, 483 bp, Ctenocephalides felis
  misc_feature (37)..(37): n = unknown
aatggctcctccaccatacgcagacttggggaaacangctagggaggtatttaacagtggctatcattttggtcttttcaaattgaatttgaaaactaaaactgcctctggggttgaattcacttcaggaggaacttctgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgccttcttacatgatagtgttgcagtaaatgctgatgtaaatttgaatttatcaggacctttgatcaatgccagcgcagtagttggttatcaaggatggtggcggtatcaaactggatttgactctgaaaattccaa

SEQ ID NO: 2104 - DNA, 550 bp, Ctenocephalides felis
gtccaaagtgtttgttgctcttgccatcattggctttattggggctgcccaagcctttttcgatcaagatgctgtcttagataagatggtagatgacatttctgctgaatatgaaaacagcattgcaagaattagccaagacagcaaaattgatatgattgctgcagaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggctacgcacaagaagcccgtgctaaggtcaaagcttgcagggatgataaacgtgatgaattcaaccaagttcgcaaaatggcttggccgctggagagaagccagggagaacgccgaagccctcagagcacaagccaaggagtgcgttgtgaccgccgccgtgtcgatgaaccagacttgttgaagagtcctccagctgccgcgaagactaagacttgccaggtttcaagaacctgtccaatgggc

SEQ ID NO: 2105 - DNA, 465 bp, Ctenocephalides felis
atttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggagccacatcattgtgcttcgtctacccacttgatttc

SEQ ID NO: 2106 - DNA, 524 bp, Ctenocephalides felis
agtttactacggtccgtgcaatagaccatcaagtgactgctttaattccgaatgataaaaattaattaagattaaaagtatttacatacattaaacgcaaaaattaaatctcatctcctcttttatgtgcagtttacttgattgtcgttcggaaaaaaaatcaaagttcgtcgagcgcgtggtgactaatgtctgttgtaccggcggcgtgacaacatcttttaaaaaattatttcagtttgaaattaaaaattttattttttaaataattttgtgaaaatatttatcataacatattttataaaaatttaatattgttgaattgtgataattaattatgaattcgtacttgttaacattactcttggcaccgttcatcatctcgatctgctcagctgattatgtcgatcgaggaaaaactgaagacacaaacttttggttgaagtggccaagataatttgaaaagagtgctccaaatgaaagaatcgagatccccagtgccaaaatgtgggtcatgattggcg

SEQ ID NO: 2107 - DNA, 548 bp, Ctenocephalides felis
  misc_feature (33)..(34): n = unknown
gcataatcaatagttttttaattgaaagctggnntgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgtcgccaataattcttacatgatctgagttcaaaccggtttaagccaggtggtctatccttatttttaaaattaatagacgaaaggccttaatttataataatatttaattgaataaataaaaaaaaaaaaaaaaaaa

SEQ ID NO: 2108 - DNA, 547 bp, Ctenocephalides felis
  misc_feature (515)..(515): n = unknown
cagtagccggcagaccgttttatttgctccattactcttattgttggcgaaattagtgcacgatggctcaaccactagctacatctgatatcaagtataccaagctattcatcaacaatgaatttgtcgattctgtaagcggaaaaaaatttcctaccattaatccaaccaatgaaaaaaaaattatagacgtatcggaaggtgataaggccgatgtagatctggcagtcgcagctgccaaaaaagcgtttgcgctaaactcatcatggcgccagatggacgcatctgcacgcggaaagctactcaacaagtttgctgacttgattgaaagagatattcaatatttagcaaatttagaaaccttagacaatggaaaaccattttctaatagtattatagatatacaatgcgctatcaataccatcagatattatgcggctggtgcgacaaaattcatggacatacaattcagcagattatggattgccagcttcattccgccaccagtggtgtangggtcaaatttccttgacttccaatgcttggg

SEQ ID NO: 2109 - DNA, 452 bp, Ctenocephalides felis
ggacggagctcgagtgaaacagtattagcaattaattgtaattaatcaaaaagtacaagaaaatgggtgtaccaagtggagatgtagaaaagggcaagaaattgttcgtccaacgttgtgcccaatgtcatactgttgaagcaggaggcaaacataaaacaggtccaaaccttcatggattgtttggtagaaaaactggtcaagcccctggattcgtgtacacagatgccaacaaagcaaagggaatcacgtggaacaaggacacactatttgaatatctcgaaaatccaaagaaatatatcccaggaacaaagatggtgttcgctggattgaagaagccacaagaacgcgcagacttaatagcatatttagaatcaagcacaaagtagaaaatgaaataaattaaatgaataattacaattatattgctaaaaaaaaaaaaaaaaaaaaaa

SEQ ID NO: 2110 - DNA, 534 bp, Ctenocephalides felis
gttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaacttttttttattaaaacataaataattgaataattgatccataaattatgattaaaagattaagttcttaagggataacagcgtaattatttttaagagaacatatcgacaaaatagattgcgacctcgatgttggattaagataattttaaaatgcagaagttttaaaatttggctgttcgccattaattcttacatgatctgagttcaaaccggttaagccaggtggttctatccttaatttttaaaattaattagtacgaaggccattaattatataatatttaattgaataaataaaaaaaaaaaaaaaaa

SEQ ID NO: 2111 - DNA, 507 bp, Ctenocephalides felis
ctccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggaccacatcattgtgcttcgtctacccacttgatttc

SEQ ID NO: 2112 - DNA, 549 bp, Ctenocephalides felis
tattcaaattaaaataattattataaattaatggtcctttcgtactaattaattttaaaaaattaaggatagaaaccaacctggcttaaaccggtttgaactcagatcatgtaagaattaatggtcgaacagaccaaattttaaaacttctgcattttaaaattatcttaatccaacatccgaggtcgcaatctattttgtcgatatgttctcttaaaaataattacgctgttatcccttaagtaacttaatcttttaatcataatttatggatcaattattcaattatttatgttttaataaaaaaaaagttttataaattttcctatcaccccaataaaatatattaatataaataaatttaataatattcttaaaattaatctatatttatatataaaactttaaagggcttctcgcctttaataatatttacgctttttaacataaaaattagcacgagggggggccggtacccaattcgcctatagtggtcgatacaattcactgccgcgtttacacgcggactgggaaaccctgcgtcccact

SEQ ID NO: 2113 - DNA, 549 bp, Ctenocephalides felis
tgaagatacttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcgctggtttggccgtaggattttccggcttggcggcgggttttgcgattggaatcgtggtgatgctggagtacgaggaacagcccaacaacctcgtctgttgtggaatgatcttgatcctgatcttcgctgaatattgggtctatatggtctatcgtaccatctacttacccaaataaacaaatattatggttt

SEQ ID NO: 2114 - DNA, 549 bp, Ctenocephalides felis
gtcgccctcatcaaggttcgaagaccattccggttgaataacagaactgttagaacagtcaaacttactgatgttggaaaagacatgccatcaggagaattagccactgttactggctggggaaatttaggggaagatgaagacgaccccgaacaactgcaatatgtaaaggtacctattgttaactggactcagtgcaaaactatatatggaaatgaaggactaataattacccaaaatatgatttgtgctggttatcctgaaggcggtaaggactcttgccaaggagatagcggtggcccactcgtcaactctaagggagttctgcatggaatagtgtcttggggaataggatgtgcacgacccgaaatcccaggagtatatacccgagtggcttcaaaaccaataagagaatttatcaaaatgcacactggaatataagagttttaacttataatattacaaatattttttgtattccttaatttcaatgatatctaagacgagatgtttacaaatttgtactcactaacaaataaacctatactc

SEQ ID NO: 2115 - DNA, 111 bp, Ctenocephalides felis
  misc_feature (81)..(81): n = unknown
gagagagagagagagagagagagagagagagagagagagagagagagagagagagagagagagagagagagagagagaganagagagagagagagagagagagagagattt

SEQ ID NO: 2116 - DNA, 549 bp, Ctenocephalides felis
  misc_feature (34)..(34): n = unknown
  misc_feature (531)..(531): n = unknown
gttatgtaatttaaaatgaaataataataataantaatagtagattagtattgtaaaagaaaaattaaaattgtgtataagtaaatttaatttattgtatcttgtgtatcagagttaatttaataaaagatatgaagaatatttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaatttttataaaaataatatttaaaattataaaaaatatgaataatgataaatagataattaattatgntatattaattggtaggtt

SEQ ID NO: 2117 - DNA, 549 bp, Ctenocephalides felis; identical to SEQ ID NO: 234

SEQ ID NO: 2118 - DNA, 527 bp, Ctenocephalides felis
  misc_feature (429)..(429): n = unknown
gttcttcagatatttactaaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcncaaaatggcttgccgctggagagaaccagggagaacccgaaccctcaagcacaagccaaggatgcgttgtaccgcaccgatgtcgatgaaccagactt

SEQ ID NO: 2119 - DNA, 549 bp, Ctenocephalides felis
gccatttttgacagtgggttcgctagtttagtgaagtgagtgtgtgaagatacttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcctggtttgccgtaggattttccggcttgcgggggttttgcgattggaatcgtggtgatgctggagtacgaggaacagcccaacacctcgctgtggtggaatgatcttgatctgtcttcgctgaagtatgggtctatatggcctatcgac

SEQ ID NO: 2120 - DNA, 549 bp, Ctenocephalides felis
  misc_feature (32)..(33): n = unknown
ctgaaatttcggaaatgctgaagacatcttgnntttttgctctggtggctttaagcctctttcaaatttcaattgccattcctaccatagaggcagaaccaatccaaaatgctattccaacaaccttcgaaatcagtcaaagaggtattgtctcagatgttttgcaggagttggtatacaatttggacgttttagttaccgaagtttttgataatgtagctaaagtaactacagacataaccactggcctcggtaaagttttagttgcactaaccaaagaaatagaagctgttcaaaaggaaccttgaatttgataagtgaagcaattagaataaagtccgaacttttgcttagatttagagatgcattgatgagaccagccttgtctaaagcaaagctttccttggaacgacttgaaaaggctgtttcaatggctattgatgatgctagacttaaatttgaaaatgcctccaagaaatgaatgacgacgcagtagcattcttaattcatcctgaaaaatcaagaggaaccgagagatcaaaacaaata

SEQ ID NO: 2121 - DNA, 549 bp, Ctenocephalides felis
  misc_feature (498)..(498): n = unknown
cttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcgctggtttggccgtaggattttccggcttggcggcgggttttgcgattggaatcgtggtgatgctggagtacgaggaacacccaacaacctcgtctgttgtggaatgatcttgatcctgatcttcgctgaagtattgggtctatatggcntatcgagccatctaccttacaccaaataaacaaatattatggattcaagat

SEQ ID NO: 2122 - DNA, 549 bp, Ctenocephalides felis
  misc_feature (109)..(109): n = unknown
  misc_feature (117)..(117): n = unknown
attgtaggataacccacaaataatatgaaatgtaaaaaaaaatgtcaaccggtgacacaaaatactggagacaattattataacatgtaatattcaatttttaaatttncatcaatngttttttatgatctcgtcttttgaagtattcattcatttattcaatccaatgccaaatcataaatttattggtatttaggtgcactactatattgaattaataagataaacaacttagttatgaaatatttcaattaaatccatgtatggtttgtaatgtgcatatatatatagtcaccgtactagatttttattagtttaagaaaatttaatataaataactatgtaagaaatatttcaaaaaatttaatataaatgactttataaaatatatatcaaaaatagtcataaaaagtttgtgcaattataaaaatttatacagaaattataaatttggagagaaaaatatgcacatatgtaatagaaatattttatcatgtgctaaatagatgcaatgaaaatatttatcaagaaatatttgccatttaaaca

SEQ ID NO: 2123 - DNA, 549 bp, Ctenocephalides felis
  misc_feature (4)..(4): n = unknown
taantttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggtttatttaaggaattcggcaaatataatattcacctgtttaacaaaaacatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagtttatatataaatatagattaatttaagaatttattaaattattatattaatatatttattggggtgaaggaaattataaactttttttattaaacataata

SEQ ID NO: 2124 - DNA, 549 bp, Ctenocephalides felis
  misc_feature (40)..(40): n = unknown
  misc_feature (508)..(508): n = unknown
ctcgaatttaaaagggtaaatttattatttaatttaatgnaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggttatttaaggaattcggcaaatataatattccctgttaacaaaaacatgcttttgaaataattaaagtctatctgccatgaagattaaaaggcgcanaatttgctggcaaggagcatatcatagttttaatggaagct

SEQ ID NO: 2125 - DNA, 549 bp, Ctenocephalides felis
  misc_feature (513)..(513): n = unknown
gtcgagtttgcaaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgctggagccacatcattgtgcttcgtctacccacttgatttcgccgaccagatggccgtgatgaggnaagcgctggcaacgtgaatcttggatggcactgttg

SEQ ID NO: 2126 - DNA, 244 bp, Ctenocephalides felis
atttttaagagaacatatcgacaaaatagattgcgacctcgatgttggattaagataattttaaaatgcagaagttttaaaatttggtctgttcgaccaataattcttacatgatctgagttcaaaccggtttaagccaggttggtttctatccttaattttttaaaattaattagtacgaaaggaccattaatttataataattattttaatttgaataaaattaaaaaaaaaaaaaaaaaaa

SEQ ID NO: 2127 - DNA, 549 bp, Ctenocephalides felis
ggtcaaagtgtccggtgcgttgtggataaaatttattaaatttattaataaattattaataaattggtggtttattatttttaaaatttacagtacacatcaagcataattttcaaaaatggtccaagaaaccgaatgcaaattaaatggatcctcaaaccccgaggaaactaatgtgattcacggtccagccgcgcctgccaacgaaggtttgaggggctttggagaggaaatttatgacagaatagttttacatggcgatagagtatccatgatcgacggagacaccgatcgctccaccaccttcgacgcccttcgggcacgcagtgcagcaatcgctctagccctaagggctcgtggagtgaccaacaaagacgtcataactttggtagaactcaccacagaagactcttttgcattgttttggggataattttctcaggagccactttagggatgttggatggagcctgacagtcccaaacactgtagtaccctactaccttatataaaccagggttctgttacacatgtccagtgttgataagg

SEQ ID NO: 2128 - DNA, 515 bp, Ctenocephalides felis
gaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgcaaaatagattgcgacctcgatgttggattaagataattttaaaatgcagaagttttaaaatttggtctgttcgaccattaattcttacatgatctgagttcaaaccggtttaagccaggtggtttctatccttaattttttaaaattaattagtacgaaaggccattaatttataataattattttaattgaataaaataaaaaaaaaaaaaaaaaaaaa

SEQ ID NO: 2129 - DNA, 549 bp, Ctenocephalides felis
gtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgccaaaatggcttgccgctggagagaagccagggagaacgccgaagccctcagagcacaagccaaggagtgcgttgtgaccgagccgtgtcgatgaagccagagtttgctgaaagggttctcaagctgccacgaaggacaaaagac

SEQ ID NO: 2130 - DNA, 486 bp, Ctenocephalides felis
caaaaagctacataagctagaaccattagaccacaaataatatatcactagacatttttaggaagtttacagtttgttatacaattcttaaactaatttagttatcagtaagttttaagcagtcggcacagtctttacggacttgtactaagttgtccctaaattctttcaaggctccccttgcgcattttccgacttcacggactaagttgcccaattgggaccaggtttctttgagtgccttggccaagtcttttgctccttcgtgggcagcttggagaacccctttcaagcaaactctggcttcatcgacatcggctgcggtcacaacgcactccttggcttgtgctctgagggcttcggcgttctccctggcttctctccaggcggcaagccattttggcgaacttggttgaattcatcacgtttgtcatctctgcaagccttgaccttagcacggcttcttgtgcgtacctagacttttgg

SEQ ID NO: 2131 - DNA, 549 bp, Ctenocephalides felis
aattcggcaccagcagagagtctgtttggcacgaagttgcttaaagccttcagtggacgctgaaacaattaaaattattctagtcaaatattacattggtagtttaaagcctcgtgtgtgcttgaagacaaaaagtgcctttgtacaaaaacaaacagtgatatttaatttatgaaatcgttataaacgtgtgtcgtatgatacttggatatttataaaaaaaagtgatacttgttagtcagtttaaaccctatatgcacaaagggatataataagacatagttaaaattattgcaaaaatggttggaagtaacggtacaatgatggcaatacgtgttgttcgcagtaaactgaggaaacgcgaagagcactctaactctgttcatccagaggcgccccagacaattacggcggttgtaccacctgctgagccagtggcgtacaggcaacaacccatctggtgttccgccgaacccgcgcagcccttcctgtacagcagcaatcaggacaccctgcacaaaatttgagccgcagcggtagcttccgtag

SEQ ID NO: 2132 - DNA, 549 bp, Ctenocephalides felis
  misc_feature (33)..(33): n = unknown
gtagattagtattgtaaaagaaaaattaaaatngtgtataagtaaatttaatttattgtatcttgtgtatcagagttaatttaataaaagatatgaagaatatttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgtaatattaaatggtaggttattaaggaatccgcaattatattccctgtta

SEQ ID NO: 2133 - DNA, 549 bp, Ctenocephalides felis
attttcttgaggctcaccactagtttcacgaaccctttctacaattgatataaattcgattatattaaaaaataattcaatttccattttcagaaggggcaacagtggctgcccacgtcgtccaggtcgatgcaggcgccgttggggaagcagacgacgttctggcgcaacttgacgcggcgctctacgtgaatcttgaaactgttggccacccaacggtagagagactcagattcactttctgatactccgaaggccaaaaatttatcagataattctttaggtatgtcgaggtcgtcggggaccctaagtccagtgtgacatctggctcttgttataggatagaatcccaaaggaaatttgctttccataatgctgaagccgcgggccaactcgaacagaaggaagtaggagcgttcttcatcgctttccaagccatcgtagatctccttgaacgatttaacaggcacgtatcaggatgagcggttcattatatgtacaggattgcgtcagcaggacacctgccacgccagaatgaaccagacaata

SEQ ID NO: 2134 - DNA, 549 bp, Ctenocephalides felis
ccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttgcatctggtggtgctgctggagccacatcattgtgcttcgctacccacttgattcgccgtccagattggccgtgatgaggtaagcctggcaacgtgaatc

SEQ ID NO: 2135 - DNA, 539 bp, Ctenocephalides felis
gaccaggaaggctatagataccaagtagccgaaatagtcacattgccattcgattccgaaacaaataattatgatttggcacttgtaaaagttaagaagccaattaagttcaactacagggtacaaccaattcctttgggcgaagaatatgtcgaaggaggtgaagaagctcgtcttacaggatggggcagattaggagctgatgaccctgcaccaaacgaattgcaggaattgaatacttttaccatcagccacaaaatttgcaagaaggctcaccagcatgtggtttacccaagtcagatatgtgcatttgtagaaaaaggaaaaggagcttgcatgggtgactccggtggtccattggtcgtaaatggagaacttcacggggttgtctcttggggaatcccctgcgccctcggcaaacctgacgtcttcactagagtctcacactatgccgaatggatcaaggagaagatcgccgtgatgaatgataaaattgtgtaattatattgaaataatattgaaggataaaaaaaaaaaaa

SEQ ID NO: 2136 - DNA, 549 bp, Ctenocephalides felis
cgagctataaattaccaatatttcttcacctttgtggaacatgtcaaaagaacatataaaaattcaaatcttcaacctgatgaaaagaaaaaaatgactaaactgatacaaagtttgccttcttctgttcaggctgctgcatatacggacacgttttgtatacgaaataaagagtctgataattatttgaaagtttattatgaaggatcctggcaggttcatctttcacctggcgatacagcttatcaaggcacaaaatgggttatcgaaaagccgacaccgactactattttttttataattagaagttttcgcttgggatggtacatcgacaataaatataatattaaatcgaaacacgcgcatactccatgggtcaggtttgatgtaaacatgaaacaaaattatgtatatttgtcagtgatgataagtatataacagactacgaaggcagtatgactttcgatacaaaaccgctaatttttcgcagtggatttacaaatgtgtgatataaagatctaataataatgtgatgcattgactaaatga

SEQ ID NO: 2137 - DNA, 549 bp, Ctenocephalides felis
gcaataaaaatgaaaaaaacagttcctttctgtttaactttgtgcctttttcttgcaaaagtagtgcatgccgaagtatgcatggagtgcaatgactgcgatacattcgaaggcaagattgttagcatatgtaatggagaattatgctacgctaaactagaaaaaggtaaagttaatcgagggtgcgcaacgaaggatatctgcgatggcaatactctttgcaaaacttgtgtcggtgctacatgcaataataaggatttcgagcgcccgtcatgtgcaacggatgacggaggagaaaaaaaatgtgaaggattgtgttacatctatgttaacggcactgaaacaaaaaaaggttgtttggtcgatttacctgaagctgattcgattagaaaagaatgcgaaaatgcacatctgggtcttgtctaaagtgcaatagtaacctatgtaataaaaatgatccctgaatgtgtaaaatgcaacgaaaatgatgccctgcacaagcaacactgctgcggaattgcagctaagtgcagtctgcagataacaaga

SEQ ID NO: 2138 - DNA, 549 bp, Ctenocephalides felis
gtcgatttcttgctagattctcattgaagtccatcattagttttccaaatcctttgacattagataaacgtagtactatttaagcacaaaaaggtataaaataataaaatggctagccagactcagggaattcaacaacttcttgccgctgagaaaagggctgctgaaaaagtctccgaggccaggaaacgcaaagcacgcagactaaagcaagctaaggaagaagctcaagatgaaattgagaaataccgtcaggaacgtgagaagcaattcaaagaatttgaagcaaagcatatgggctcacgggaaggggttgcagctagaattgatgctgacactcgtgtcaaaatcgatcagatgaacaaagctgtgtctgttcaaaaggatcccgtgatgtatgaaattctgaagttggtctatgacatcaaaccagaattacacaaaaattatcgcaaagaataatttattttattcagagctccagtgaaaaaatatatattaataaagatatgttatatccacattttgttatgtgaaaaaatcttatag

SEQ ID NO: 2139 - DNA, 547 bp, Ctenocephalides felis
  misc_feature (517)..(517): n = unknown
ctaccttcactcacgtctacttgaacgtgccgctaaaatgtctgaagctcatggaggtggctctttgactgctttgccagttattgaaacacaagctggtgacgtatcagcttatattccaactaatgtcatttccattactgatggtcaaatcttcttggaaactgaattgttctacaagggtattcgaccagccatcaatgtaggtttatctgtatctcgtgtaggttctgctgcacaaaccaaagccatgaaacaggttgccggttccatgaaactggaattagctcaatatcgtgaggtggctgcttttgcccaattcggctcagatcttgatgcagccacacaacaattgttaaacagaggtgttcgtttgactgaattattgaagcaaggacaatatgtcccaatggctattgaagaacaagttgcaattatctactgtggtgtccgaggacacttggacaaaatggacccaaccaagatcacagcatttgaaaggaattacgctcacatnaaccaaccatcatcctttgcaaccatgcca

SEQ ID NO: 2140 - DNA, 549 bp, Ctenocephalides felis
aaagtacgtgttggcagttctgaaataaaccatggaggaatgatattcgacattgaattttatgcccttcaccctgattatccagaagatcatgatgacacatccgattatgacgtggctcttgttaaacttgcatatccgctcaagtttagcgaagacatccaaccgatcatgatggccgaaaaggactatgaaccgccagcaggaaccaaagcttatgtgtctggatggggaagaacatcgttcggtggccaattgtctaaaaatctgcgaggagtcgagttggaaataatagatctattcgattgtttcctttcctacttggataaagtaaacgtgtccgaaaggcaagtttgcgctggaatccccgttgtaggtggtaaagattcttgcactggagactcgggtggccccttaccatcgatggaatcttggcggaactgttcctatggcgaagattgcccaaagcagaatatcctggagtttattcaaatattgtgaatacagagatggattgaagactataagagtgagtcataaatgtattat

SEQ ID NO: 2141 - DNA, 544 bp, Ctenocephalides felis
gaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggttaagccaggtggttctatccttaattttttaaaattaattagtacgaaaggccattaatttataataattatttaattgaataaataaaaaaaaaaaaaaaaaaaaaaaaaaaaa

SEQ ID NO: 2142 - DNA, 549 bp, Ctenocephalides felis
gcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgcaaaatagattgcgacctcgatgttggattaagataattttaaaatgcagaagttttaaaatttggctgtcgccattaattcttacatgatctgagttcaaaccggttaagccaggtggttctatccttaatttttaaaattatagtacgaaaggccata

SEQ ID NO: 2143 - DNA, 549 bp, Ctenocephalides felis
  misc_feature (4)..(4): n = unknown
  misc_feature (34)..(34): n = unknown
cgantttgcaaaagagttttatttaatttattgntgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggagccacatcattgtgcttcgtctacccacttgatttccccgaccagattgccgtgtgtagtaaaggcctggtaacgtgaatttctggatggcaactgttga

SEQ ID NO: 2144 - DNA, 530 bp, Ctenocephalides felis
gaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgttcgaccaataattcttacatgatctgagttcaaaccggttaagccaggtggttctatccttaattttttaaaattaattagtcgaaaggccattaattataataattatttaattgaataaaataaaaaaaaaaaaaaaaa

SEQ ID NO: 2145 - DNA, 504 bp, Ctenocephalides felis
ataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtcgaaaggccattaatttataataattattttaatttgaataaaattaaaaaaaaaaaaaaaaaaaaaaaaa

SEQ ID NO: 2146 - DNA, 542 bp, Ctenocephalides felis
caaataaagtttgtttgtgaaaaaaagtatttgtataatttggattatttccactatatcagattactcatttgaaccatgtctctcgtaccattgttgtttcacgattggtgggaggattacgaccatccaatgcgcctcatggaccaacatttcggaatgggcctaaatcgaaatgatcttattactaatctgcgggcaactccatccctcttccgtggcggttattacagaccttggaggaatgaaattactgctgacgattcctcgtcgaccatcgttgctgacaaagataaattccaagtgaccttagacgttcagcaattcaaaccaaaagaaatcaccgtaaaaacaaaggacaattgcgtaattgtggaaggcaagcatgaagaaaaacaagatgagcacggatatatttcccgtcattttgttcgcgatatgtcttgccagaaatcacgatgctgccgatgtagtatctagttgcctcggatggagtattgccatacagcgcccaagaagcccttcagctgacagacgagtgg

SEQ ID NO: 2147 - DNA, 549 bp, Ctenocephalides felis
aaaacatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttcttaagggataacagcgtaattatttttaagagaacatatcgcaaaatagattgcgacctcgatgttggattaagataattttaaaatgcagaagtttaaaatttggctgtcgccataatcttacatgatctgagtcaaccggttaagccaggtggtctatcctt

SEQ ID NO: 2148 - DNA, 510 bp, Ctenocephalides felis
  misc_feature (155)..(155): n = unknown
  misc_feature (412)..(412): n = unknown
  misc_feature (473)..(473): n = unknown
aatattaactgtcttaataaaattgttatagaatttaatttttatgttaaaaagcgtaaatattattaaaggacgagaagaccctttaaagttttatatataaatatagattaattttaagaatattattaaatttatttatattaatatatttnattggggtgataggaaaatttataaaactttttttttattaaaacataaataattgaataattgatccataaattatgattaaaagattaagttacttaagggataacagcgtaattatttttaagagaacatatcgcaaaatagattgcgacctcgatgttggattaagataattttaaaatgcagaagttttaaaatttggtctgccgccattaattcttacatgatctgagttcaaaccggtttaagccaggtnggttctatccttaattttttaaaattaattagtacgaaaggccattaattataataattantttaatttgaataaattaaaaaaaaaaaaaaaaaaaa

SEQ ID NO: 2149 - DNA, 549 bp, Ctenocephalides felis
  misc_feature (512)..(512): n = unknown
  misc_feature (524)..(524): n = unknown
  misc_feature (533)..(533): n = unknown
agaaaaattaaaattgtgtataagtaaatttaatttattgtatcttgtgtatcagagttaatttaataaaagatatgaagaatatttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagataatataatttattgtaatattaaatggtaggttattaaggattcgncaatatatattncctgttaanaaaactgcttttgaaa

SEQ ID NO: 2150 - DNA, 299 bp, Ctenocephalides felis
gctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaattacatgtatctttttaataaaaataaatcgtttgggccgttaaaaaaaaaaaaaaaaaa

SEQ ID NO: 2151 - DNA, 549 bp, Ctenocephalides felis
  misc_feature (515)..(515): n = unknown
tgaaataataataataataatagtagattagtattgtaaaagaaaaattaaaattgtgtataagtaaatttaatttattgtatcttgtgtatcagagttaatttaataaaagatatgaagaatatttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagatttaaatttttataaaaataatatttaaaatataaaaaatatgaaataatgattaaatagataatataattatgntatattaaatggtaggttattaaggatccgccaa

SEQ ID NO: 2152 - DNA, 546 bp, Ctenocephalides felis
gttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttcttaagggataacagcgtaattatttttaagagaacatatcgacaaaatagattgcgacctcgatgttggattaagataattttaaaatgcagaagttttaaaatttggtctgttcgaccattaattcttcatgatctgagttcaaaccggttaagccaggtggttctatccttaattttttaaaattaattagtcgaaaggccttaattataataattatttaattgaataaataaaaaaaacaaaaaaaaaaaaaaaa

SEQ ID NO: 2153 - DNA, 547 bp, Ctenocephalides felis
taaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaagccctcagagcacaagccaaggagtgcgttgtccgcaccgtgtcgatgaaccagacttgttgaaagatgtcttcaagctgccgtgaaggac

SEQ ID NO: 2154 - DNA, 549 bp, Ctenocephalides felis
ataatgattaaattagtataatataatttattgataatattaaattgttaggtttatttaaggaattcggcaaatataatattcacctgtttaacaaaaacatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgacctaaattatgattaaaagataagttacttaagggtaacacgtaattatttttaagagaacatatcgcaaaatagattgcgcctcgtgtggtaagata

SEQ ID NO: 2155 - DNA, 547 bp, Ctenocephalides felis
caggtacaggttgcgttagagcctctgaaaatacattaaactgtcctgatcaaactcctcccgtagacaacagttttgtatgcgaatctattggtattttccctgatctggaagactgtaagaaattccatttctgtattccaaatacagaaggtgttaaagcttccaacagaagcttttacctacattctgaaattgaaaatatgtccatagaagcaatcaaaagtcagaccagagttgacaaaacaaaaccacgccaaaaatctattgaacacacctgcgacagaggttatggatacgatcctatgacggccatgtgcagcataaaattggataatggcgaatgtgcgaatagggataaaatccaatgcaaagctgttggcgagtctaacgctctcagccttggttcgagctacttctacgtctgcatagagttgctggaggatatgcaaatctcaaggcaacttgtcctaggctatataggtgccccatggtgaattttcttcaaggtcctgatcgaacaagatgatgaagatgaagataatct

SEQ ID NO: 2156 - DNA, 549 bp, Ctenocephalides felis
aaaaatatgaaataatgattaaattagtataatataatttattgataatattaaattgttaggtttatttaaggaattcggcaaatataatattcacctgtttaacaaaaacatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgaccataaattatgattaaaagattaagttacttaagggataacagcgaatattttaagagacatatcgcaaaatagattgcgcccgat

SEQ ID NO: 2157 - DNA, 271 bp, Ctenocephalides felis
  misc_feature (18)..(18): n = unknown
  misc_feature (22)..(22): n = unknown
  misc_feature (28)..(28): n = unknown
  misc_feature (42)..(42): n = unknown
  misc_feature (246)..(246): n = unknown
ctgtcttaataaaattgntatngaattnggtttttatgttanaaagcgtccatattattaaaggacgagaagaccctttaaagttttatatataaatatagattaattttaagaatattattaaatttatttatattaatatattttattggggtgataggaaaatttataaaacttttttttattaaaacataaataattgaataattgatccataaattatgattaaaagattaagttacttangggataacagcgtaattatttttaa

SEQ ID NO: 2158 - DNA, 481 bp, Ctenocephalides felis
  misc_feature (234)..(234): n = unknown
  misc_feature (286)..(286): n = unknown
  misc_feature (318)..(318): n = unknown
  misc_feature (355)..(355): n = unknown
  misc_feature (361)..(361): n = unknown
  misc_feature (365)..(365): n = unknown
  misc_feature (423)..(423): n = unknown
  misc_feature (440)..(440): n = unknown
aacttcatgtactataatattatatttgtattatatgtattataaattcatacatgcacacacacacatatgtatatatatatatatatatatatatatatatatagttcaaaaataatagcagctaattattcaaccaacatgataatataactgttacggattcttcacaattattcaatattgaataattcagaatatatatatatatatatatatatatatatatatatncatgtgtacgaacatgtatatgtgtatatatatatatatatatatatatttntatatatatatatgtatattcgcacatgtgtntgtacatgtatataggtatagatgttttttttgacanacatantgtntattagtatatatataaactatagtataaaaatataaatgagtggttcatttactttntgcacacctgactcatngaatcttgctttctaagacataaaatagaataattaaaatt

SEQ ID NO: 2159 - DNA, 546 bp, Ctenocephalides felis
tttagtgaagtgagtgtgtgaagatacttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcgatcattccagttgttatggctggtatcattgctatctacggcctggttgttgcggtactgattgcgggtgctctggaggaaccaaaaacctactcactttataagggcttcatacatctcggcgctggtttggccgtaggattttccggcttgcggcgggttttgcgattggaatcgttggtgatgctggagtacgaggaacacccaacaacctcgtctgtttgtggaatgatcttgatcctgatcttcctgaagattgggtctatatggcttatcgtaccatctaccttacacc

SEQ ID NO: 2160 - DNA, 550 bp, Ctenocephalides felis
cagttatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgtcgccattaattcttcatgatctgagttcaaaccggttaagccaggtggttctatccttaatttttaaaattaattagtacgaaagaccataattataataatatttaattgga

SEQ ID NO: 2161 - DNA, 541 bp, Ctenocephalides felis
aggaatgccttaaaggccaacaccaaaaagctctaggttttgcacaagaagctcgtgctaaggtcaaggcttgcagggatgataaacgtgaggaattcaaccaagttcgccaaaatggcttggccgcctggagagaagccagggagaacgccgaagccctcagagcacaagccaaggagtgcgttgttaccgcagccgatgtcgatgaagccagagcttgcttgaaagatgtccttcaagctgcccgtgaaggagccaaggacttggccaaggctttcaaagaaacctggtcccaattgggcaacttggttcgtgaagtcggcaaatgcgcaagaggagccgtgaaggaattcagagataacttggtacaagtccgtaaagactgtgctgactgcttaaaacttactgacaactaaattagtttaggaattttataacaaactgtaatttgcttaaatttgctttatgatcagctagttgtatattatttgaatttgatggtttagtttttatgtacattttgcaaataaaattgttatga

SEQ ID NO: 2162 - DNA, 518 bp, Ctenocephalides felis
cttaacctacaataaatttttaacttattctattttaaattgcaatttttatttatctatatattattttaaaatgtgcacagatttgtcgagagttttgtctattcagagtcatgtagtgtcaggatatgttggaaataaaagtgccacttttcctctgcaagtattaggatttgaagtggatactatcaattccgtgcagttttctaatcatactggatataaacatgtacgagggcaagttctaacggacaaggaattaggagagctggcagaagggttagcattgaatggtatcaatgtctacagtcacttattaacgggttatgtagctaatccagattttcttaaaacaattgcaaacgtcgttaaggaattgagagaaaaaaatccaaaattgacatacgtttgcgatccagtgttaggtgataatggaaaaatgtatgttccagaatcattattaccaatttatagagaattaattattccatggctgatattgtactccaatcaattga

SEQ ID NO: 2163 - DNA, 537 bp, Ctenocephalides felis
  misc_feature (507)..(507): n = unknown
aggcactaaacctttcggatttttagacgattattgtcgcctggtgatagttgtcaaaggtgaaggactggagaatggcgataacacggtcaaattgtctttcttcgtcaagacacttccacgatataatgaaaacagattaagacaaattcatcaacatggtgttttcagaaaggaaactatgatgtactaccttttgctaccaatgctcaaaggcgataatggacccacagcctggcgtccaaaatgcttcctcgtccgcaacgacatagtcgttttgcaagatttatccatgtataattttcgccattcgtacccaaaattctctttggatcttgatcatgttaaagttgctttaacggcattggctcgtatgcatgcaagttgcattatctacgagaagaaaaaaaattgttgcatggggagagtttacaaagatcttatgttcgagactatggccaataataatcaatggtggaggactggagaggatctgcttagcaattntgaggaatctgagaatcgtaaatatccgat

SEQ ID NO: 2164 - DNA, 546 bp, Ctenocephalides felis
  misc_feature (8)..(8): n = unknown
  misc_feature (42)..(42): n = unknown
  misc_feature (411)..(411): n = unknown
  misc_feature (430)..(430): n = unknown
  misc_feature (512)..(512): n = unknown
  misc_feature (519)..(519): n = unknown
cggcccgngagtttgtcgtgggacgactcattattatttatnttgtgataatcttttaaatctcctaaaatgaggatctacaaagacatcattactggtgatgagatgttctcagacacatataaaataaagttggtcgatgaagttttgtacgaagtgaccggcaaattggtttcaaggtctcaaggggatatccaaattgaaggtttcaacccatctgctgaagaggctgatgaaggaactgaaacagccacggaatctggtgttgatgtggtcttaaatcaccgctttgtgaaacttttgccttctcagataaaaaatcatacactctttatttaaaagattatatgaaaaaattggtggcgaaattagaggagaaatcaccagaacaagttgaggtattcaaaacanatatgaacaaagtcatganagaaatattaagccgtttaaagaatgcaaatgtcactggtgaatcaatggttgtgatggcatggttgctttatggaattcgngaaatantggtgaattgtccatttgatgtcttaa

SEQ ID NO: 2165 - DNA, 537 bp, Ctenocephalides felis
gtgaaccccaagtattgggttttcccgatggtttcccacgggttgtaggtggacacactgccaatgagcatcaattcccatggcaagtatccctccaaagatttggaagtcacttctgcggtggttccatcatcaattctgaatgggttctcactgctgctcattgcatcagtggcacttccggatttgatgccgtagtaggaaaacacgatctttcaaaaactgaagctactgaacagcgatctgccttcaagagaactattgtgcacaaatcttatgctggaggcgtcaatccttatgacatcgctttgatccaagttgccacaccattcaagctgatcgaaaacgttaaagctgttaagcttcaactaaagatgaggctcactcaggacaagttacattgctggatggggatctacttctacttcagcttccccagctccctaataaactacagactgttgacaaaccaattgtccataccccgagtgtgaaaaggcttaggaggacaggatctactcattgacccaacaactt

SEQ ID NO: 2166 - DNA, 534 bp, Ctenocephalides felis
  misc_feature (34)..(34): n = unknown
  misc_feature (56)..(56): n = unknown
  misc_feature (91)..(91): n = unknown
ctggaatgaatgattgaatgaaatattaactgtnttaataaaattgttatagaatntaatttttatgttaaaaagcgtaaatattattaanggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggttaagccaggttggttctatccttaattttttaaaattaattagtacgaaaggccattaatttataataattatttaatttgaataaaattaaaaaaaaaaaaaaaaaaaa

SEQ ID NO: 2167 - DNA, 550 bp, Ctenocephalides felis
aggaggcgaggcggagatttttttacgtgaaagactttgaggagtgattgtttatcagcaaccaacagaaaatggggtccgagatgaaaagtacatgctacaaatgcaatcgcgtaggacactttgccagagaatgcacccaaggaggcggaggtatgggaggtggccgggaccgcgatggcggtcacagggactcgggccgcgtgcgtgagaaatgctacaagtgtaatagatttggccactttgccagagactgcaaggaggaggctgaccgatgctacagatgcaatggcactggacacattgctcgcgcttgtctgcaaagcccagatgagccatcctgttacaactgtaacaagccaggacacattgcgaggaattgtcctgagagcggtggttatgactctcagagtaggtccaaccaagcgtgttacaactgcagcaaaactggtcatatatccgtactgccagaaaatgctaaacttgtatgttgtggaaagctgtcacataaccgtgatggatcaaatgaccacactagtcaatatatcta

SEQ ID NO: 2168 - DNA, 550 bp, Ctenocephalides felis
aaagtgtccggtgcgttgtggataaaatttattaaatttattaataaattattaataaattggtggtttattatttttaaaatttacagtacacatcaagcataattttcaaaaatggtccaagaaaccgaatgcaaattaaatggatcctcaaaccccgaggaaactaatgtgattcacggtccagccgcgcctgccaacgaaggtttgaggggctttggagaggaaatttatgacagaatagttttacatggcgatagagtatccatgatcgacggagacaccgatcgctccaccaccttcgacgcccttcgggcacgcagtgcagcaatcgctctagccctaagggctcgtggagtgaccaacaaagacgtcataactttggtagaactcaccacagaagactcttttgcattgttttggggataattttctcaggagccactttagggatgttggatggagcctgacagtcccaaacactgctagtccctctcctttatataaccaagggttctgttacacatgtccagtgttggataggcaagaa

SEQ ID NO: 2169 - DNA, 546 bp, Ctenocephalides felis
  misc_feature (450)..(450): n = unknown
ttcagatatttactaaatattgtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctagctacgcacaagaagcccgtgctaaggtcaaggcttgcagagatgacaaacgtgatgaattcaaccaagttcgccaaatggctggccgctggagagaancagggagaacccgaaccctagacacaaccaaggatgcgttgtgacgcagccatgtcatgaagcagagttgcttgaaagggttctccaactgccacg

SEQ ID NO: 2170 - DNA, 550 bp, Ctenocephalides felis
tagatttccacatgcatccctcgtacaataagagggcggattatgattttgacgttgctgtactagaacttgaaaaaccagtctcatatacggtttgtacagtagtatcagtagatttagccgaaagtggaactgaagttaaacctggagcaatacttagtgtcactggatggggtgcaactaaggaaggtggtggcggaactttgcaactacaaggtgtgaaagttccagctatctctcccaaagattgtgctaagggatatccaccttctggaggtaaagacaaaattacagacagcatgttatgtgctggtcttcctgaaggaggtaaagattcctgccaaggcgacagtggcggtccactggtagatgaaaatagaaagcaagtaggagtggtttcttggggtcaaggatgtgccagaccaggaaaaccaggaatttatgctaaagtgtcacaccccgaaatcaggaaatttattgaaaaatatgctaatgttaagtggattcatttcaatataatgtgattaagatctcttatgtatgattgaat

SEQ ID NO: 2171 - DNA, 550 bp, Ctenocephalides felis
ctcatcttacaagataaaggatggattagatgggcgcattgttggaggacaagatgctgatattgccaaatatggctatcaagcttcactccaagtatttaacgaacatttctgtggagcttcaatattgaataattattggattgtcacagcagctcattgcatatatgatgaattcacgtattcagttcgagtcggcaccagtttccaaggaagacgtggttccgttcatcctgtggcacaaattatcaagcatcctgcatacggtaatgtaactgacatcgatatggatgtcgccctcatcaaggttcgaagaccattccggttgaataacagaactgttagaacagtcaaacttactgatgttggaaaagacatgccatcaggagaattagccactgttactggctggggaaatttaggggaagatgaagacgaccccgacaactgcaatatgtaaaggtcctattgtaactgactcagtgcaaaactattatggaaatgaagactaataatacccaaaattgattgtgctggtatcctgaagcgg

SEQ ID NO: 2172 - DNA, 550 bp, Ctenocephalides felis
  misc_feature (4)..(4): n = unknown
  misc_feature (522)..(522): n = unknown
  misc_feature (536)..(536): n = unknown
cgtnttacaatattaaacgtgaattcgttttgccgggtcgtagtaaccaatttaatataatggctcctccaccatacgcagacttggggaaacaagctagggaggtatttaacagtggctatcattttggtcttttcaaattgaatttgaaaactaaaactgcctctggggttgaattcacttcaggaggaacttctgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgcttcttacatgatagtgtgcagtaaatgctgatgtaaatttgaattatcaggacctttgatcaatgccagccagtagttggtatcaaggatggtggccggtatcaaactggatttgntctgaaattcaagncacaaagacacttg

SEQ ID NO: 2173 - DNA, 496 bp, Ctenocephalides felis
  misc_feature (433)..(433): n = unknown
  misc_feature (475)..(475): n = unknown
tcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgccattaatcttacatgatctgagttcaaaccggttaagccaggttggttctatccttatttttaaaattaattagtncgaaaggccattaattataataattattttaattggataaantaaaaaaaaaaaaaaaaaaaa

SEQ ID NO: 2174 - DNA, 539 bp, Ctenocephalides felis
  misc_feature (29)..(29): n = unknown
agaccctgctatatcgggtcgagtttgcnaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggagccacatattgtgcttcgctacccacttgatttcgccgtaccagattggccgctgatgtaggtaaagcctg

SEQ ID NO: 2175 - DNA, 542 bp, Ctenocephalides felis
  misc_feature (33)..(33): n = unknown
ctgtgttaatttaataaaagatatgaagaatgnttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgtaggtttatttaaggaattcggcaaatataatattccctgttaacaaaaacatgctttttgaaaataatataaagtctaatctgccatgaagattaaaa

SEQ ID NO: 2176 - DNA, 540 bp, Ctenocephalides felis
  misc_feature (29)..(30): n = unknown
taggaatgccttaaaggccaacaccaaanngctctaggttttgcacaagaagctcgtgctaaggtcaaggcttgcagggatgataaacgtgaggaattcaaccaagttcgccaaaatggcttggccgcctggagagaagccagggagaacgccgaagccctcagagcacaagccaaggagtgcgttgttaccgcagccgatgtcgatgaagccagagcttgcttgaaagatgtccttcaagctgcccgtgaaggagccaaggacttggccaaggctttcaaagaaacctggtcccaattgggcaacttggttcgtgaagtcggcaaatgcgcaagaggagccgtgaaggaattcagagataacttggtacaagtccgtaaagactgtgctgactgcttaaaacttactgacaactaaattagtttaggaattttataacaaactgtaatttgcttaaatttgctttatgatcagctagttgtatattatttgtaatttgatggtttagttttttatgtaacatttgacaataaaaatggt

SEQ ID NO: 2177 - DNA, 542 bp, Ctenocephalides felis
atttttactaaatattgtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacgccgaaccctcagagcacaagccaaggagtgcgttgtgaccgcagccgtgtcgatgaaccagagtttgctgaaaggggttctcca

SEQ ID NO: 2178 - DNA, 518 bp, Ctenocephalides felis
  misc_feature (29)..(29): n = unknown
  misc_feature (37)..(37): n = unknown
  misc_feature (466)..(466): n = unknown
ttattaactgtcttaataaaattgttatngaatttantttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtacgaaaggccattaattnataataattattttaatttgaataaaattaaaaaaaaaaaaaaaaaaaaaaa

SEQ ID NO: 2179 - DNA, 540 bp, Ctenocephalides felis
  misc_feature (29)..(29): n = unknown
ttattccaagtgcattctgaaatttcggnaatgctgaagacatcttgcatttttgctctggtggctttaagcctctttcaaatttcaattgccattcctaccatagaggcagaaccaatccaaaatgctattccaacaaccttcgaaatcagtcaaagaggtattgtctcagatgttttgcaggagttggtatacaatttggacgttttagttaccgaagtttttgataatgtagctaaagtaactacagacataaccactggcctcggtaaagttttagttgcactaaccaaagaaatagaagctgttacaaaaggaaccttgaatttgataagtgaagcaattagaataaagtccgaacttttgcttagatttagagatgcattgatgagaccagccttgtctaaagcaaagctttccttggaacgacttgaaaaggctgtttcaatggctattgatgatgctagacttaaatttgaaaatgccatccaagaaatgaatgacgacgcagtaggcattcttaattcctcactgaaaaat

SEQ ID NO: 2180 - DNA, 542 bp, Ctenocephalides felis
atttactaaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgcaaaatggcttgcccgctggagagaagccagggagaacgccgaaccctcagagcacaagccaaggagtgcgtgtaccgcaccgtgtcgatgaaccagacttgttgaagatgtcttcaagctgcc

SEQ ID NO: 2181 - DNA, 542 bp, Ctenocephalides felis
caatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggttaagccaggtggttctatccttaattttttaaaattaattagtcgaaaggccattaatttataataattattttaatttgataaaattaaaaaaaaa

SEQ ID NO: 2182 - DNA, 540 bp, Ctenocephalides felis
  misc_feature (29)..(29): n = unknown
ttcgacttctgagtggttacggcagaagntacgtaagcacactccaaaaaatactatcagtgctcataaaggatttaatattctccgtacagtagcttacaggtgagatcaatttaattcaactcaactggctatacattttattacaagatgcactccgtaatcaattccactttgcgaaccctgagcaaaacagaatcgggtaaaatcgcatcgattttatcgaacagcaggagttatgctgccaaagcagcagcaggtgcccaaggcaaagttgttgccgttatcggtgctgttgtagatgtacaattcgaagatagcttacctcccatcctaaatgctcttgaagtatccaacagaaagccaaggctcgtccttgaagtagcccagcatttaggagaaaataccgtccgtacaattgctatggatggtaccgagggtttggtacgtggtcaaggtgttgttgactgcggatcacccatcaggatcccgtgggagctgagacattgggcaggatcatgaacgtcatcggagaccaat

SEQ ID NO: 2183 - DNA, 542 bp, Ctenocephalides felis
attgtatcttgtgtatcagagttaatttaataaaagatatgaagaatatttttctcgaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgtaggttatttaaggaattcgcaaatataatattccctgttaacaaaaactgtcttttgaaataatataaagtctaatctgcca

SEQ ID NO: 2184 - DNA, 539 bp, Ctenocephalides felis
atggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttggccgctggagagaagccagggagaacgccgaagccctcagagcacaagccaaggagtgcgttgttaccgcagccgatgtcgatgaaccagacttgcttgaaagatgtccttcaagctgccgtgaaggaccaagacttgccaag

SEQ ID NO: 2185 - DNA, 540 bp, Ctenocephalides felis
  misc_feature (30)..(30): n = unknown
ataaatcattttcaaaatggtgtccaaagngtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaagccctcagagcacaaccaaggatgcgttgtaccgcaccgatgtcgatgaaccagacttgcttgaaagatgtccttcaagctgccgtgaaggaccaag

SEQ ID NO: 2186 - DNA, 497 bp, Ctenocephalides felis
  misc_feature (31)..(31): n = unknown
gcaacttgtgtcaggtgacagtcttgtgatngatctggtgttggctctgaaatagttcgaacaggatcagagtgtgttttaaaacgacaaataaccaaaggagccaaaatgcctcaagaacttaataaaatctcggatgaagagcgagagggaaaattcggctatgtatacgccgtttctggtcctgtcgtaacagctgaacgtatgtcaggatcagctatgtacgaattggtacgtgtaggatactatgaacttgtcggagaaatcattaggttggaaggtgatatggctactattcaggtatatgaagaaacatcaggtgtaactgtaggtgaccctgttctaagaacaggaaaaccattgtccgtagaacttggaccaggtatcttgggaagtatctttgatggtatccaacgtccacttaaagatattaatgagttaactcaatcgatttacattcccaagggtgttaatattcctgctctgcaaaaacacag

SEQ ID NO: 2187 - DNA, 495 bp, Ctenocephalides felis
ttgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtacgaaaggccattaatttataataattattttaatttgaataaaataaaaaaaaaaaaaaaaaaaaaa

SEQ ID NO: 2188 - DNA, 471 bp, Ctenocephalides felis
aaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtacgaaaggccattaatttataataattattttaatttgaataaaattaaaaaaaaaaaaaaaaaaaaaaa

SEQ ID NO: 2189 - DNA, 522 bp, Ctenocephalides felis
  misc_feature (485)..(485): n = unknown
gaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgccattaattcttcatgatctgagttcaaaccggttaagccaggttggtttctatccttaattttttaaaattaattagtcgaaaggccattaatttataataattattttaatttnataaaattaaaaaaaaaaaaaaaaaaaaaaaaaaaaa

SEQ ID NO: 2190 - DNA, 486 bp, Ctenocephalides felis
  misc_feature (419)..(419): n = unknown
tgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgncgctggagagaaccagggagaacgccgaagccctcagagcacaagccaaggagtgcgttgtaccgca

SEQ ID NO: 2191 - DNA, 471 bp, Ctenocephalides felis
ataaaaatgggtttcatgtttaatattgatggtggctatctggaaggcctgtgccgtggtttcaagtgcggaattcttaaacaatccgattatttaaatcttgtgcaatgtgaaactcttgaagatttgaagctgcacctggcaggtacagattatggcacctttttatcaaatgagccttcccccttatctgtgtctaccattgatgacaaattacgtgaaaaattggttattgaattccaacacatgagaaaccatgctgtcgaacctctgtccactttcttggatttcataacctacagttatatgattgacaatatcattttgttgatcactggtacactccatcagagaccaatttctgaattgattcccaaatgccacccacttggaagtttcgaacaaatggaggctattcatgtagctgcacccctgcagagttatacaatgctgacttgtggatccccactt

SEQ ID NO: 2192 - DNA, 550 bp, Ctenocephalides felis
gttgtacctctagtttgcgtattagctaatgttgctatagccaaagcattctctgtcggatgctctgtagatgcttcgcaagaaatgttcactctaggaatatgtaatatatttggcagtttcgtgaagtcgatcccaacttgtggtgctttcaccagatcagcagtcagcaatgcaagtggtgttcgctctccaatggcaggcttgtactcaggtactatgacgcttttagcgttaagttttctcactccatacttttactatattccgagagcaactctttcatcagtgttgatatgtgctgttatgttcatgtttgattggcaaatagtgatgccaatgtggcggactaataaattggacgtgttatttatggggtgtacatttgctgcatctttatataaaggagtagaatttggcttaagtgtggtgtaattctgactttatgtcctttgctctatttgtgggcaaggccgaaattaatcacatatctaagtggcacccgaagtcttgaatatcggtgtatcccagacacagtcttacttcctcg

SEQ ID NO: 2193 - DNA, 550 bp, Ctenocephalides felis
gcgcgccttacataaatagcgccaaattcacatgtctcacggatggcgtgaaaaaggaaacatcttgtgcagcagattcatgttttcttttatacaataaatataaaggtgtgcgggagtatggttgcataataaaaattacgcagagccaaagaaaatactgtttccgtcatccagaattatgctttacctgcgacacgaaaaactgtaattcaatgaaactgatgaaactatgccgcgaatgcctcacaaacggccaaggcggagacgaacgttgcaccaccgacccagcagcactcgggaatcgatcggtcacattgtgctacaccgattgtgccgcatatagagtattcgatggttctaatgtgcgggggtgctttccagaagggagcgtttgtactcctggcagttgcattcgttgctccgaggatatgtgtaacgacgtaaaagttcctgaatttcgtcgaatatgtaacaccaatagcacacatcagaaattgctctgaagtcatgacgctgcatggcgtttgactctgagtaacctgtactg

SEQ ID NO: 2194 - DNA, 550 bp, Ctenocephalides felis
ggaaagcagctgctgataaataccaaataaagtttgtttgtgagaaaaagtatttgcataatttggattatttccactatatcagattactcatttaaaccatgtctctcgtaccattgttgtttcacgactggtgggaggattacgaccacccaatgcgcctcatggaccaacatttcggaatgggcctaaatcgaaatgatcttattactagtctacgggcgactccttccctcttccgtggcggttattacagaccttggaggaatgaaattactgctgacgattcctcgtcgaccatcgttgctgacaaagataaatttcaagtgactttagacgttcagcaattcaaaccaaaagaaatcaccgtaaaaacaaaggacaattgcgtaatcgtggaaggcaaacacgaagaaaaacaagatgaacacggatatatttcccgtcatttcgttcgacgatatgttttgccagaaatcacgatgccgccgatgtagtatcgagtttgcctcggatggagtattgcctacagcgcccaagaaggccttca

SEQ ID NO: 2195 - DNA, 550 bp, Ctenocephalides felis
gcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgtcgccattaattcttacatgatctgagttcaaaccggttaagccaggtggttctatccttaatttttaaaattaattagtacgaaaggccataattataataatatttaattggataaaataaaaaaaaaaaaaaaaaa

SEQ ID NO: 2196 - DNA, 550 bp, Ctenocephalides felis
  misc_feature (487)..(487): n = unknown
  misc_feature (516)..(516): n = unknown
gaatttaaaagggtaaatttattatttaatttaatgtaatataattatttaaaataataaattagtaatgaaatgttattcgtttttaaagttatctagtttttttagaaataaatttaatttattatatttaaatatttatattaatttattaaatatagatattttaaatataaaatatttttagggataagcttaaaaataaattattataaattaataaattatttataaatttatagggttataaatattcattaatataaaaatgttataatttatttataaataaattaaaatttagtagattttaaattttttataaaaataatatttaaaattataaaaaatatgaaataatgattaaattagtataatataatttattgataatattaaattgttaggtttatttaaggaattcggcaaatataatattccctgttaacaaaaacatgcttttgaaaataatataaagtctaatctnccatgaagattaaaaggcgcagtaatttnctgtgcaaggacataatcaatgtttttaattgaa

SEQ ID NO: 2197 - DNA, 461 bp, Ctenocephalides felis
gaaaaagttatattcaataactataaagtttatagagtaattgctgacaacttcgaacaagttgaggttctgaagaatttggaaaaggactctgatgcgtacaatttctggacccatgttggagccccaggcaaaaatgtagacatcatggtacccccacacaaacttgaggatttcgaaagcacgatgcaataccatagaataaaccacagtgtaatgagcgatgacgtccagaaagatatcgacctagaagtttttggtacaagtagagaagcttacagttggaccaagtatcaagatcttgaaacaacctatgcatggatggacagcttagccaaggcacacccaggaaaagtcactgttctcaccattggcaaaacttttgagggaagagacatcaagggagtcaagatttcattcggactgcaaaccaggcgtattattgcgctggatcacgcccg

SEQ ID NO: 2198 - DNA, 550 bp, Ctenocephalides felis
  misc_feature (496)..(496): n = unknown
ctaaatattgtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacgccgaagccctcagagcacaagccaaggagtgcgttgtgaccgcancgtgtcgatgaaccagagtttgctgaaagggttctcagctgccacgaaggacca

SEQ ID NO: 2199 - DNA, 377 bp, Ctenocephalides felis
ccgcaaggtaaaatcagtagtcaccttggatggtgataaactgactcatgaacaaaagggtgataagcccaccaaaatagtccgtgagtttggaccaactgaaatgaaagcagttatgactgttgatgatgtggtctgcacgagaacttacaaagcattgtaatttcaacactacggttttctatttttgtccttaagttatatgcatactcgtatggaatctgtatataatacagaactaatttgactaattatggtcattgatagtgattgctgcatttgtttcatacttgttaaagtactgatttaaactttttttgtatttatcgaaagatgaaatataaacattaaaaaatttaaaaaaaaaaaaaaaaaaa

SEQ ID NO: 2200 - DNA, 550 bp, Ctenocephalides felis
ctaaatattgtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacgccgaagccctcagagcacaagccaaggagtgcgttgtgaccgcaccgtgtcgatgaagccagatttgcttgaaaggggtctccagctgccacgaaggac

SEQ ID NO: 2201 - DNA, 168 bp, Ctenocephalides felis
atttgtgttaatggtttaaaattttggttattcacataattttagaattgattcatgttgaatgtatgatgtaaaatttccctttaatttaagaataatagttctttatttgtttaatttcaatgtagttgatgaaataaattaaaaatgataaaaaaaaaaaaaaaa

SEQ ID NO: 2202 - DNA, 534 bp, Ctenocephalides felis
cgctagtttagtgaagtgagtgtgtgaagatacttcaatcagattctttcttggacctgtaaatactccgcataaattacaaaatgtcttcatcagttctaccagaagaaaatccaatctatggacctttctttggagtcatgggcgcagcgtcggctatcattttcagcgcactgggtgccgcatatggaacagccaagtccggcactggtatcgccgctatgtccgtgatgagacctgaattgatcatgaaatcaatcattccagttgttatggctggtatcattgctatctacggcctggttgttgcggtactgattgcgggtgctctggaggaaccaaaaacctactcactttataagggcttcatacatctcggcgctggtttggccgtaggattttccggcttgcggcgggttttgcgattggaatcgtggtgatgctggagtacgaggaacagcccaacacctcgtctgttgtggaatgatcttgatcctgatcttcgctgaagtattgggtctatatggcttatcg

SEQ ID NO: 2203 - DNA, 550 bp, Ctenocephalides felis
atttcaatggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccagaaagtcccaaatttttgatgaatcagggaagaaacgaagaagctcgtcaaattattgccaaaatgtatagaattaatactggtaaaccagaaagtgaattccccgtatcatcaatcttagatgaatatccaggagtggatggtgaaaatcaaataaaacaaagaaatcatttttaagaactgatgggatcaaactgctccgtgttatgggtgacacatgaaaaaacactcattgctgtctctgcaattcggaatttgcacattaacggatg

SEQ ID NO: 2204 - DNA, 550 bp, Ctenocephalides felis
caatgtcgggaggcttggatgttcttgccctacgggaagatgatgttaccaaaatgttagccgcatgcacccatcttggcagcgaaaatgtgaacttccagatggagcaatatgtgtacaaacgccgtgctgatggagtacatgtaatcaacttacgtcgcacatgggagaagcttttgttggctgctcgtgctattgttgctattgagcatccagctgatgtcttcgttatttcctccagacctcaaggacaacgtgcagtattgaagttcgccaactatactggtgctactccaattgctggacgtttcactcctggtgccttcactaatcagattcaagctgcattccgtgaaccacgtttgctgattgttactgatcctcactccgatcaccaacccatcactgaggcttcatatgtgaacattcctgttattgcattcaccaacactgattctccattgaaatttgtgatattgcaattccatgcaacaccaagtccaaccattccgtggttgatgtggtggtgtgctagaaagcttgagattcg

SEQ ID NO: 2205 - DNA, 236 bp, Ctenocephalides felis
agagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtacgaaaggaccattaatttataataattattttaatttgaataaaattaaaaaaaaaaaaaaaaaa

SEQ ID NO: 2206 - DNA, 550 bp, Ctenocephalides felis
gatatttactaaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacccgaaccctcagagcacaaccaaggatgcgttgtccgcaccgtgtcatgaaccagacttgttgaagatgtcttcaagctgccgtgaagacc

SEQ ID NO: 2207 - DNA, 550 bp, Ctenocephalides felis
ccagaccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgctgcagtctctaagactgtggtggcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgctggaccacatattgtgcttcgtctacccacttgattcgccgtccagatggccgtgatgaggtaaagcctggcaacgtgaatct

SEQ ID NO: 2208 - DNA, 541 bp, Ctenocephalides felis
  misc_feature (514)..(514): n = unknown
gcgaatttgcccgtcttacaatattaaacgtgaattcgttttgccgggtcgtagtaaccaatttaatataatggctcctccaccatacgcagacttgggaaaacaagctagggaggtatttaacagtggctatcattttggtcttttcaaattgaatttgaaaactaaaactgcctctggggttgaattcacttcaggaggaacttctgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgcttcttacatgatagtgttgcagtaaatgctgatgtaaatttgaatttatcaggacctttgatcaatgccagcgcagtattggtatcaaggtggtggncggtataaactggttgcttgaaattca

SEQ ID NO: 2209 - DNA, 550 bp, Ctenocephalides felis
gcgatttcctttttattccggctaagtgagaaaacacaaacacaaccaaaatggacgcgatcaagaagaaaatgcaagcgatgaagctggaaaaggagaacgcaatggaccgcgctctcaactgcgaacaggaagctaaggatgccaacctgcgcgctgagaaggccgaggaagaggcccgttctctgcaaaagaagatccaatcaattgagaacgatcttgaccaaactcaggagtcattgatgcaagtcaatggaaaactcgaagagaaagacaaggctcttcaaaatgccgaatctgaagtcgctgccttgaaccgacgcattcaactcttggaagaagatttggaacgttcagaagaacgtcttgccaccgccaccgctaaattggctgaagcctcacaggctgctgatgaatcagaacgcgcccgtaaggtgcttgagaaccgtccctcgcgaggaagagcgcatggacgcacttgagaaccaacttaaagaacgcgattctgcgctgaggaggccgcaagaaatccgatgagttgccgtaattg

SEQ ID NO: 2210 - DNA, 545 bp, Ctenocephalides felis
  misc_feature (511)..(511): n = unknown
ccgggtcgtagtaaccaatttaatataatggctcctccaccatacgcagacttggggaaacaagctagggaggtatttaacagtggctatcattttggtcttttcaaattgaatttgaaaactaaaactgcctctggggttgaattcacttcaggaggaacttctgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgccttcttacatgatagtgttgcagtaaatgctgatgtaaatttgaatttatcaggacctttgatcaatgccagcgcagtagttggtatcaaggatggttggccggttataaactggatttgactctgaaattccaagncacaaagacacttgccttggatctcacagagatt

SEQ ID NO: 2211 - DNA, 550 bp, Ctenocephalides felis
ctcgctgtctgcacattcggtgccagtgttccagaatcatggaaaagattagatggtagaatcgtaggaggacacgataccagcatcgataaacaccctcatcaagtatctttattgtactccagccacaattgtggtggttccttgattgccaaaaactgggttttgactgcagctcattgcattggagttaacaaatacaatgtccgtgtaggaagttccatcgtaaacagcggtggtatcttgcataaagttaaaaaccattacagacatccaaaatacaacgcagctgctattgactttgattacgcactcttagaactcgaaactcctgttcaactcacaaatgatgtgtccatcataaaattggtcgatgaaggagtagatcttaaacctggtaccttgttaactgttactggatggggatcaactggaaatggaccttcaaccaatgttttgcaagaagttcaagtaccacatgtcgaccaaaccacttctcaaatcttacccaggaagttgactgatcgatgtctgcctggtatttggacaa

SEQ ID NO: 2212 - DNA, 472 bp, Ctenocephalides felis
aaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtacgaaaggccattaatttataataattattttaatttgaataaaattaaaaaaaaaaaaaaaaaaaaaaaa

SEQ ID NO: 2213 - DNA, 550 bp, Ctenocephalides felis
  misc_feature (547)..(547): n = unknown
aattcggcaccagccagagcagaatgcactaaaggtgaacaattggttgtcacctttgctgctggttacattgccggtgtattctgtgcagtagtttctcatcctgcagacacagttgtttccaagctaaatcaagacaaaggagcaacagccattgacgctgccaaaaaaacttggctttgctggtttatggaagggattaggacctaggatcatcatgattggtacattaaccgctgcccaatggtttatttatgatgccgtcaaagtctggttgcgtatgccacgaccaccaccaccagagatgccagaatctctcaagaagaaattagctgcccaacagtaaaaatagatctgtgatgatcctctcaataatgcatgtatcagcaatattacaattgaaattgcaactaacatctaaaatagcagtatcagtgatggactattcaatttagtaacaatgctgctaactggatcacgttttcattccaaattttaatttaaatgaaatagcaattatatagtatacaattcttttacaaatttngaa

SEQ ID NO: 2214 - DNA, 542 bp, Ctenocephalides felis
attgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacccgaaccctcagagcacaagccaaggagtgcgttgtaccgcaccgtgtcgatgaaccagacttgttgaagatgtccttcagctgccgtgaaggacca

SEQ ID NO: 2215 - DNA, 221 bp, Ctenocephalides felis
  misc_feature (177)..(177): n = unknown
  misc_feature (180)..(180): n = unknown
gttggattaagataattttaaaatgcagaagttttaaaatttggtctgttcgaccattaattcttacatgatctgagttcaaaccggtttaagccaggttggtttctatccttaattttttaaaattaattagtacgaaaggaccattaatttataataattattttaatttgaatnaanttaaaaaaaaaaaaaaaaaaaaaaaaaaaaaaaaaaaaaaa

SEQ ID NO: 2216 - DNA, 381 bp, Ctenocephalides felis
  misc_feature (33)..(33): n = unknown
  misc_feature (179)..(179): n = unknown
attaagacttcctttatgattaagatttatatnattaggatgaattaataattataaccatatatttagtcatctagtgcctcaaggaactccaataattttaataccttttatagtttgtattgaaacaattagaaatattattcgacctggtactttagccatccgactctcagcanatataattgctggacatttaattctaactttacttggcaatacaggaaactccctatctatatgattaatttgaattttaattttctctcaattaattttattaattttagaaattgctgtatctattattcaatcttatgtatttgctgttttaagaactctttattctagagaaatttactaaaaaaaaaaaaaaaaaaa

SEQ ID NO: 2217 - DNA, 287 bp, Ctenocephalides felis
ctacattccaatattttaattaatttgttgttaattttgataacgttgattttatccagatgtttgttgtgtacaaagtatttatctcgggccaaaccaattgtaacagtattttgaatttcattttatgatgaagccagaccggatttgggcgcacatgagtttctatatatataaaatgaattaccgacataatatagcctaattatcctcaatttagaaaatatcattgttaactatatttagaatatattatctttttgttgtataaaaaaaaaaaaaaaaaa

SEQ ID NO: 2218 - DNA, 550 bp, Ctenocephalides felis
  misc_feature (517)..(517): n = unknown
aaaacttcatctcctaaatgatggtcaatgttacataaaattgtataagatagtttgtgttaaattttacgacgctttgataatttattaataaacattaattgatatcagagtagagtcaaatcgatatataatattattttacctacttctctggaatacaaatttattaataaatatcgatttcagttacaagctgatcagtagtatattttctgtggtcaaggattgtcatcatgtcaactaaaataatattattatccgcattgctgttgctaatatcttccactgccgtccaggcccaagtatgcagttgtgtatgcatcacaatatgctgcacccccgaacagctttcaaccctcgcctgtcccaagcgcagcagcagcagacggcctgctgccaaactcaccctcctaaaaataatgctgatgcttacctcgaatcatacagcacaaaatattttaaatcagtacttacatcacagcagtgcgacaatccaaagtcaggacaaaaattnttggcacagcagcattgtaaccagcaccatcgt

SEQ ID NO: 2219 - DNA, 226 bp, Ctenocephalides felis
  misc_feature (162)..(162): n = unknown
  misc_feature (193)..(193): n = unknown
  misc_feature (202)..(202): n = unknown
tagaatttaatttttatgttaaaaagcgtaaatattattaaaggacgagaagaccctttaaagttttatatataaatatagattaattttaagaatattattaaatttatttatattaatatattttattggggtgataggaaaatttataaaacttttttnttattaaaacataaataattgaataattganccataaatnatgattaaaagattaagttactta

SEQ ID NO: 2220 - DNA, 550 bp, Ctenocephalides felis
  misc_feature (34)..(34): n = unknown
aagacaatcaatcaaaattcataaaaaagttatnaaaagttagaaaaatggttacaaaagtagcactgttagttcttgctgttgctgtcgcccaagtttcctgcgatggattaacatggaagtaccatccatctctttcagcatttatgctgaaaggtaaagacgaaatgggtaaagattgttcagctcctggagaaataaagtgccaggattgtgagacagcaaacctttgcattgcgattggtgctgatttcttagaaacaacattggaaacatgtccgagtggaatgacttgcaaaccaggtacaggttgcgttagagcctctgaaaatacattaaactgtcctgatcaaactcctcccgtagacaacagttttgtatgcgaatctattggtattttccctgatctggaagactgtaagaaattcatttctgtttccaaatacagaagggttaaagcttcaacagaacttttcctacattctgaaattgaaatatgtcatagaacaatcaaaagcagaccagagtgcaacaaacccgccaaaattat

SEQ ID NO: 2221 - DNA, 550 bp, Ctenocephalides felis
  misc_feature (33)..(33): n = unknown
  misc_feature (489)..(489): n = unknown
  misc_feature (539)..(539): n = unknown
  misc_feature (544)..(544): n = unknown
aagatttgatattagttttattggatttgcagntgaaagtttatttatcacaatggttgatacatatttgaacaaaaaatataagctcagttcgagtgaaaattttgatgattatatgaagaaattgggtgtcagtctagtcacccgtaaattgggcaaccaagtgagcccagtggtagagctgactaagaatggagatacctataccttgtcatccactagcaccttcaaaaattccatcatcacattcaaacttggtgaagaatttgatgaagagactcctgatggccgcaaggtaaaatcggtagtcaccttggatggtgataaactgactcatgaacaaaagggagataagcccaccaaaatagtccgtgagtttggaccaactgaaatgaaagcagttatgactggtgatgatgtggctgccgagaacttacaaagcattgtatttcaacactccggtttctattttgtcttagttatatgcanctcgatggatctggtatatacagaactaattgctaatatggcattgtagngatgntgattg

SEQ ID NO: 2222 - DNA, 498 bp, Ctenocephalides felis
ttgtcagcgtttgtcgttcccgagtgctagattaggttatttaggattgttggccgatattccatcatctgggtaggctaaaatcaaggatcggaaagacgatcgagacgaacaaccatacaaaaatattttttagaacaaaatcaataaaaatttcaaaatgttatctcggattctaaaacctcttttaaatggatctactagagcgttttcgactacaaacaagaataatgtcaaggttgcggttttgggagccgctggtggaattgggcaaccccttagtcttttattgaaacagtcccctttgatcagtcgcctgaatttgtatgatatccttggaacgattggtgtggcagctgacttaagtcacattgaaacacctgccaaagtatgtggttacaatggcaagaagtttttgtgcaaggctttagaaggagtggatgtagtcgtcataccagcaggcagccctcgtaaacctggtatgactcgtgatgattt

SEQ ID NO: 2223 - DNA, 375 bp, Ctenocephalides felis
  misc_feature (191)..(191): n = unknown
  misc_feature (367)..(367): n = unknown
agcgaatacattttggtgttgaaatgaaattattattattataatttttgataaatttgaattgggaaattcttgaaaaaatcaaaaaagaattacaaaattaatattaagaagatgaacttaaatatagtaatttgaaaataaatatgaaattaagggtgtaaaatataattgtcacagttgggttagtnttaatttaatgaaaagataaattgttatgtaccagtgtacgccaaattttaaaaaaaaacttatgaaaatatcaatgtatgaaagatgaaataaatgaacacaataatttcatgtgtatgtaaacaagttcaataataataaagttgaatacatgtcaaaaaaaaaaaaaaaaaanaaaaaaaa

SEQ ID NO: 2224 - DNA, 500 bp, Ctenocephalides felis
gcatatctaaaaagtttacaaattttattcaacaatatttttaaatcatcttaagaacatttcgtaagaaaatatcaatatgctaatataacacacacaagtaatacttagtttgatcatatctgtaaataacatgtgtatcatataaaatatttgattaaacctgcgatttcactgtttcttctgcttgctgctccattctaaaaagctaccttcgtagtatcttgacttcttgtaacacaatcccaatgctgtttccatagcttcctttgctcgttttccggaacggcaactaaaaatgatttcagtatcgaatgttggtttatctcttccgaatttggttttgaattcttcaggagacatgttcttgagagcattttccaattcacgtaatggaatgtttatagctgtcggaatttttccttcctgctccaattcctccggtgacgaacatcaataagtaaaacttctggttctgcggaaatacttttttctaagta

SEQ ID NO: 2225 - DNA, 500 bp, Ctenocephalides felis
ttttaattgactggactcaaaagggccactatcaaaaaaaaaagtttaccttaatttcttacatgaattagatataaaaaaaatggtaaattggacgtataaatgggacctcaaaatataatctaataaaaaaaacacctcatatatgaaacaaagaattgaagattgtatgtcttgtacttagactacaaatcttttttaagaaaatacacagaaaaatagccttacatattcgactgtttatacttgtgacaagtttaaaggatttaatttaagcgacttctgtatttatgtaattcacctactctaaattaagactgtaatttatcattatctgacatagttttttggttttacgtattttttattaaaattcttgtgaagttcaacaagtagaatattgttttttaattgggttatttggaccttagaatattctaaaatactctatttacatagagagagcaagatgcttaaatttatacaatatgtcgagtaaa

SEQ ID NO: 2226 - DNA, 500 bp, Ctenocephalides felis
aaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgcccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacgccgaagccctcagagcacaagccaaggagtgcgttgtgaccgagcgtgtcgtgaaccaga

SEQ ID NO: 2227 - DNA, 496 bp, Ctenocephalides felis
  misc_feature (31)..(31): n = unknown
tttatcatttggtataattaataaagaaccngatcattttgacagagtattggctgatatctgcaccaggtgacaagacctgccagcagacatgggagacgatgaacaatgtcaccagcaaacaaaattcattatctgtcaactacaaatttcatataccagaccttaaggtcggtacattagatcagctcgtaggtctgtctgatgatctaggcaagctcgatgtattcgttgagcagatcactcgtaaggtagcaacatatcttggtgaggttcttgaggaccaacgtgataaacttcacgagaatttaatggcaaacaacagcgatctgccatcttacataactcgcttccagtgggacatggcaagtacccaatcaagcaatctcttcgtaacatctcagatatcatcagcaagcaagtaggacagatcgatgccgacttgaaaaccaaatctcaggcgtacaacaatttgaaaggcagtttgcagaacttg

SEQ ID NO: 2228 - DNA, 498 bp, Ctenocephalides felis
  misc_feature (37)..(37): n = unknown
  misc_feature (55)..(55): n = unknown
  misc_feature (60)..(60): n = unknown
tgtgcaaaggtagcataatcaatagttttttggttgnttgctggaatgaatgatngaccngaaatattaactgtcttaataaaattgttatagaatttaatttttatgttaaaaagcgtaaatattattaaaggacgagaagaccctttaaagttttatatataaatatagattaattttaaggaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggctgttcgaccattaattcttacatgatctgagttcaaaccggttaagccaggtggttctatccttaatttttaaaa

SEQ ID NO: 2229 - DNA, 495 bp, Ctenocephalides felis
tttaaaatgccgacatacaagttgacatacttcaacgttaaggctttggctgaaccattgcgtttgttgttgtcttatggaggagccgattttgaagacgtcaggttggagaaggaaaactggccagcagttaaaaacacattcccattcggacaagtcccagttttggaaatcgacggtaaacaaataaaccaaagcttggcaattgctcggtatcttggcaaacaattcaacttgggaggcaaagatgccttagaagatttggaaattgatgccatcgttgattcaatgaacgatttcagactaaaggctgctgttgttatttatgaacaagatgaagcagtgaaagccaagaaagtcgaacaattgaccaaagaagtagtaccattctactttgaaaaattcgaggctatcgcaaaaagaacaatggacatttagcttgggaaaattgacctgggcagattcggctggctggcaattcgaagcatggaactt

SEQ ID NO: 2230 - DNA, 500 bp, Ctenocephalides felis
cgaacacgcaacatcggtagagaacattaatacacgcgcgacacaccaaatcttgcagagaatataaaacatcactaaaagcgaacggttccaaacgagatatattcgcgggttagtggtaaaaagactgatattttactcaaaagtggtaaataaaataaatcgatatcaagatgacgagttttgggtcgacgcagatttgtgccagtttgttagttcttgtagtgatcgtacaacaaggtaaagcactaagttgttacgaatgcaacagccacaacgacacgcgatgctcagaagacatacccccagaaaatttgaagaagaattgcgatgaccacaaagggggcacaaaatatacgatgtgccgcaagattacgcaagtcatcgaattcgaagtgaacggattgcgctgacacacgtgttatcagaggttgcggatgggacgagtctagttcaaggcaagtgttaccagcgtcgggtttcggtggtcgcaagaggtc

SEQ ID NO: 2231 - DNA, 500 bp, Ctenocephalides felis
gagaaaggaggcgaggcggagattgttagtacttttaagtattaacaatttaattaagtttttatttaatttcgttatttttttttaagtttttacgtgaaagactttgaggagtgattgtttatcagcaaccaacagaaaatggggtccgagatgaaaagtacatgctacaaatgcaatcgcgtaggacactttgccagagaatgcacccaaggaggcggaggtatgggaggtggccgggaccgcgatggcggtcacagggactcgggccgcgtgcgtgagaaatgctacaagtgtaatagatttggccactttgccagagactgcaaggaggaggctgaccgatgctacagatgcaatggcactggacacattgctcgcgcttgtctgcaaagcccagatgagccatcctgttacaactgtaacaagccaggacacattgcgaggaattgtcctgagagcggtggtatgactccagagtaggtcaaccaacgtgtaca

SEQ ID NO: 2232 - DNA, 500 bp, Ctenocephalides felis
attgagcgccgtctcatcttacaagataaaggatggattagatgggcgcattgttggaggacaagatgctgatattgccaaatatggctatcaagcttcactccaagtatttaacgaacatttctgtggagcttcaatattgaataattattggattgtcacagcagctcattgcatatatgatgaattcacgtattcagttcgagtcggcaccagtttccaaggaagacgtggttccgttcatcctgtggcacaaattatcaagcatcctgcatacggtaatgtaactgacatcgatatggatgtcgccctcatcaaggttcgaagaccattccggttgaataacagaactgttagaacagtcaaacttactgatgttggaaaagacatgccatcaggagaattagccactgttactggctggggaaatttaggggaagatgaagacgaccccgaacaactgcaatatgtaaaggtcctattgtaactggactcagtgc

SEQ ID NO: 2233 - DNA, 500 bp, Ctenocephalides felis
gttttgtgtcgtgtcacagatttcaaaatggataaaataaaggcaggacccgttgttgacatccttggagatgaaatgaccagaatcatttggtctctcatcaaagaaaagttgattctgccctttttggatgtcgaattgcatacttacgatttgggtatggaacaccgagacgaaactaatgaccaagtcactattgattgtgctgaggcaatcaagaaatacaatgtcggaatcaagtgtgcaacaattactcctgatgagaaaagagtggaagaatttaaattaaagaaaatgtggaaaagtcccaatggaactatcagaaatattctcggtggcacagtcttcagagaagcaatcatctgcaagaacataccccgattggtaacaggatggaatgagcccatagtcatcggcagacacgctcatgctgatcaatacaaagccccgcttcgtggtaccaggaaagggtaaattagaattgcatttcccccgaatcg

SEQ ID NO: 2234 - DNA, 500 bp, Ctenocephalides felis
atttatgcattctttaatgttggaagctggatatgcgattggatttcccataataggtgctattattaactctgtgggaaagcttccaattcttgtattcgtgatggtctcatgcgggatttgtggaataatttgtgcatttattgaacatttaacaatagcatcatatttatatttgtggttgctggtttgcggaattgctgtgacagtggtaaacgcggcattagtagatctgtaccctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcggtgttgtgaaatgcaattat

SEQ ID NO: 2235 - DNA, 500 bp, Ctenocephalides felis
  misc_feature (490)..(490): n = unknown
gtctcttaacaaaaataggttgcgaaatttagaatcaactgtgacaaaattatcaaaatctgcgccttctcttcattatttgagtttgcttggaaatttgatatgtcctgatcaattgagtgatccaacaacagacgtccaagattattttcgttataggtgttacattgtacatcatttaccaaaattattatttttggattggcgggctgtatcatcaaacgaggcaaaggaagcaaaattgcggggtcaatttatgcgggtcagaagacccgagcctaatcatgaaatcacaaataaaaacgactttagtgatgccttacattattctccgttacctaaaaccgttcatagaaaaaaaggatgtacttacagaaaatattctcagaaatatataggacgtaattcagagggcaacaagtcataaaaaacagtgatctctagggggccggtcccaattcgcctatagtgagtcgattcaattcactgncgcgtttaca

SEQ ID NO: 2236 - DNA, 500 bp, Ctenocephalides felis
agtatcagtagcatgttccaaatatattgatccaagaatcattggaggcgaagatgctcctgaaggctcggctccgtatcaagtttcactgagaaatcgggacctagagcatttctgtggtggctccatcttaaacaaacgttggattgtgacggctgcacattgcctaaaacctggcattttaaaatccgtctatatgggatcaaactcattagatggcaatggtacatactacgacgtcgaacgttttgtgatgcatcataaatatataccaaaaattactgtcaactatgctgatattggtctaataaaagtgacaaaagacattatattcagtgacaaagttcaaccaatcaaaataagcaaaaaaaatatcaagggtggtgaaatctgcaaggccactggttggggtcgattgcggatggggccccagtaccaaacgaattgcaacaagtggaaaccactgcaataacaaatgaaaagtgctacgaattgtctca

SEQ ID NO: 2237 - DNA, 500 bp, Ctenocephalides felis
  misc_feature (417)..(417): n = unknown
  misc_feature (484)..(484): n = unknown
gtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgcaaaatggcttgncgctggagagaagccagggagaacgccgaagccctcagagcacaagccaaggatgcgttgtccgcancgtgtcgatgaaccag

SEQ ID NO: 2238 - DNA, 500 bp, Ctenocephalides felis
  misc_feature (435)..(435): n = unknown
ggtaaaccaaaaattagagtatcgtacaaaggagaatccaaaaccttcttccctgaagaagtcagttccatggtgttgactaaaatgaaggaaaccgctgaagcttacttaggcaaaactgtgaccaatgctgtcgttactgtacctgcctacttcaatgactcacaacgtcaagccaccaaggattcgggaactatctccggtctaaatgtgttgaggataatcaatgagcccaccgctgctgctattgcttatggtttagacaagaagggtgtaggcgaaagaaatgtccttatttttgatttgggtggtggtacttttgatgtgtccatcttaaccattgaagatggtatttttgaagtcaaatctactgctggtgatactcacttgggtggtgaagattttgataaccgcatggttaaccacttcgtacangaattcaaacgcaaatacaagaaagatcttacctccaacaagcgtgctctccgtcgttgaggaca

SEQ ID NO: 2239 - DNA, 500 bp, Ctenocephalides felis
atcgcttagaatataatgtcgcaaagttgaacgaaggtgaatcttttgtaataagagaaaaaaatgtgagattatatgacggcgatgtaaagactaattttgaaggcggtgaaatagttcttacaagccggcgattattttggggaaggccaggcgagattcccagaggccaaacatgtataacactgccattaaatcttgtcaagggtatcgaagaagcttctgctggggtttttggtttcagcagaagcaaaaaagttatacttcatttatctccagcatctcccagtaattgcttttaaacttaataaagcatgcaaaataattcactaaaaatttgattttaatcttagacaaagtacctggaccttctgcaagcagtttatatgatttcataaaactttcattcagagaaggatattcatctgaatttattccaagtttaaatgcaactttagaagcccaagaatggagtgtgtagaagacagctctctgcccag

SEQ ID NO: 2240 - DNA, 500 bp, Ctenocephalides felis
gaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccaataattcttcatgatctgagttcaaaccggtttaagccaggtggttctatccttaattttttaaaataattagtcgaaaggccattaatttataataattatt

SEQ ID NO: 2241 - DNA, 500 bp, Ctenocephalides felis
ggcttgcagggatgataaacgtgaggaattcaaccaagttcgccaaaatggcttggccgcctggagagaagccagggagaacgccgaagccctcagagcacaagccaaggagtgcgttgttaccgcagccgatgtcgatgaagccagagcttgcttgaaagatgtccttcaagctgcccgtgaaggagccaaggacttggccaaggctttcaaagaaacctggtcccaattgggcaacttggttcgtgaagtcggcaaatgcgcaagaggagccgtgaaggaattcagagataacttggtacaagtccgtaaagactgtgctgactgcttaaaacttactgacaactaaattagtttaggaattttataacaaactgtaatttgcttaaatttgctttatgatcagctagttgtatattatttgtaatttgatggttttagttttttatgtaacattttgacaaataaaaattgttatgaaaataaaaaaaaaaaaaaaa

SEQ ID NO: 2242 - DNA, 275 bp, Ctenocephalides felis
aaacagtgaaattgcagggttaatcaaatattttatatgatacacatattatttacagatatgatcaaactaagtattacttgcgtgtgttatattagcatattaatattttcttatgaaatgttcttaagatgattttaaatattgttaaataaaatttgtatactttttagatatgcaccaaataaattaaaataaaaatctttacattcctaaaaaaaaaaaaaaaaaaaaaaaaaaaaaaaaaaaaaaaaaaaaaaaaaaaaaaaaaaaaa

SEQ ID NO: 2243 - DNA, 495 bp, Ctenocephalides felis
  misc_feature (441)..(441): n = unknown
tcacgcactttaacaaaaacatctgggcgtccagctccgcaagtgtacaagacaaacgaagaaacgccaaccagttcacctttgtaaaccagtggtccaccagaatcaccaaagcaaatgcctcttaaaaattcccttaatgtacatatttgcgaagttggctcaacgaattgagacaattcgtagcacttttcatttgttattgcagtggtttccacttgttgcaattcgtttggtactggggccccatccgccaatcgaccccaaccagtggccttgcagatttcaccacccttgatattttttctgctaattttgattggttgaactttgtcactgaatataatgtcttttgtcacttttattagaccaatatcagcatagttaacagtaatttttggtgtatatttatgatgcatcacaaaacgttcgacgtcgtantatgtccattgcatctaatgagtttgatcccatatagacggatttaaaatgcgg

SEQ ID NO: 2244 - DNA, 498 bp, Ctenocephalides felis
  misc_feature (41)..(41): n = unknown
  misc_feature (151)..(151): n = unknown
  misc_feature (406)..(406): n = unknown
atttgtcggatatacgacaagtgcccaacaatacacatgtntaaccgatggcgaaaaagaaaccacaacatgcaaactcatcaacgaatgttacgtaatttacaacacaaagtcaggaaccaccaactacggttgcctaatcaagatgacnaattcccaaagaaactactgtgccaaaaatccacacatgtgcataacttgcactggaaataattgcaataccaaagatttgatgaaaatgtgcatcacttgcacctccaaggaggacgagagatgcaccaccgatcctcagcaattggctaaaacttctgtcaggccttgcaatggtgattgcattacacatgtccttccagatggtacaaatacaaggggttgtatgaaaccaactgatgactgtgatgatatnaaatgccaggagtgcaaaggtaacctttgaatgcgtgttttcccaagaaatcgcagggtttgcaacgctaaagatgatgcaaggaagttgct

SEQ ID NO: 2245 - DNA, 500 bp, Ctenocephalides felis
ttagcaaaatactgtgaaataaatcattttcaaaatggtgtccaaagtgtttgttgctcttgccatcattggctttattggggctgcccaagcctttttcgatcaagatgctgtcttagataagatggtagatgacatttctgctgaatatgaaaacagcattgcaagaattagccaagacagcaaaattgatatgattgctgcagaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggctacgcacaagaagcccgtgctaaggtcaaagcttgcagggatgataaacgtgatgaattcaaccaagttcgcaaaatggcttgccgctggagagaagccagggagaacgccgaaccctcagagcacaaccaaggagtgcgtgtgaccgccgccg

SEQ ID NO: 2246 - DNA, 495 bp, Ctenocephalides felis
  misc_feature (52)..(52): n = unknown
  misc_feature (175)..(175): n = unknown
  misc_feature (234)..(234): n = unknown
  misc_feature (375)..(375): n = unknown
tttgtcggtttaatcatctttatatcagcgacatgtgttttcggccaaagtncttccaatgaccacaccagaattgttggaggtgcagacgccgctcctggttctgctccatttcaagtatctttaagagataaattcttgaaacatttttgtggtggatcgattcttaatgaanaatgggttcttactgctgcacattgtctagtcgcaggccgtttgagttccatctacgtnggatccaacaaactaaacaaaggaggtcgttactatgatgtcaaaaaatatattgtacatgaagaatataatcctaaaaccttatacgccgatattgggctcatagaagtagacgaagaaattcaattcaacaatttagtnaaaccgattcctaggcgaaaagaagcattggtaggcaaggagtcagtcacagctttaggttgggggttgcaaagcacgatggaaaaaatcaccaaataatttgagaaaattgacttgaaa

SEQ ID NO: 2247 - DNA, 500 bp, Ctenocephalides felis
ggtgagatagaaactgatgatgaggacaataataaaccaccagaacctattaagcctgtagaaattgttaagccacaatccccagttacactgaaaacttcagaaaatgccaaatacagtgataaaaagccatattataaagaaaaatataagaaatccagcaaacacagcaaagaaaaaagatctaagagtatctctgaatcaaatcactgtgacattaataatgaagatgactgggcatctaatgttgaaaaagctattgcaaatgcaataagaaaagaaagtgataataatgacactaattcatgtgataataaggataataaggaaggaagtaaagatagtcgtggtagaaaaagaagaaataaatcttccaaaggatcttccaataaggaatcttcagtaaaaggcctaaagttgaaaaagtcaaggaacctagcatcctgatgaagatttgatgaagatgaacttcttggtattaggggtggcagtctattaat

SEQ ID NO: 2248 - DNA, 500 bp, Ctenocephalides felis
gaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattctattggggtgataggaaaatttataaaactttttttttattaaaacataaataattgaataattgatccataaattatgattaaaagattaagttacttaagggataacagcgtaattatttttaagagaacatatcgcaaaatagattgcgacctcgatgttggattaagataatttaaaatgcagaagttttaaaatttggctgtcgccattaattcttacatgatctgagttcaaaccggttaagccaggtgg

SEQ ID NO: 2249 - DNA, 500 bp, Ctenocephalides felis
  misc_feature (35)..(35): n = unknown
  misc_feature (398)..(398): n = unknown
gactttgcaaaggtagcataatcaatagttttttnattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattntaaaatgcagaagttttaaaatttggtctgtcgccattaattcttacatgatctgagttcaaaccggttaagccaggttggtttctatccttaattttttaa

SEQ ID NO: 2250 - DNA, 500 bp, Ctenocephalides felis
gaaattagctcaaaggaaacatttcccttcaatcaattggttgatttcatacagtaaatatatgcgtgctttggatgacttctatgacaaaaacttcgtggaatttgtgcccctacgtacaaaggtaaaggaaattttgcaagaagaagaagatttatcagaaattgtacaattggttggtaaagcctccttggcggaaactgacaagatcacacttgaagttgccaagctcttgaaagacgatttcctacagcagaacagctactcatcatatgatcgtttctgccccttctataaaacagttggtatgttacgtaacattattgctttctatgatatggcaaaatacgcagttgaatctactgcacaaagtgaaaacaagattacctggaataccattagagatgctatgggcaatattctatatcagttgtcctcaatgaagttcaaggacccagtcaaggatggtgaggcaaagatcaagagtgattttgatcaat

SEQ ID NO: 2251 - DNA, 500 bp, Ctenocephalides felis
gtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaagccctcagagcacaagccaaggagtgcgttgtaccgcaccgtgtcgatgaaccagagcttgttgaaagatgtccttcaagctgccgtgaag

SEQ ID NO: 2252 - DNA, 495 bp, Ctenocephalides felis
ctgattcgtgcattaagtaaaggcggcttaaaagcagtcgtctgtgaatatacaaattctttaggcaaccatgttcaacagtttgttagaggtggcacggaattcgcctttccgtagccctattgcacctgtacaatgtgaagctgaatctaaatcattggcaacaatggcagcctccacctcagatgcaacaggagattcctgtgcctttggatctggtcattactttgctctttgcggatttggaggaattatttcttgcggtgtaacacacaccatggtcgttccacttgatttagtgaaatgccgtattcaagtagatcctgcaaaatacaaatcagtattcaatggattcaaagtaactctagcggaagatggtgctagaggtcttgctaaaggttgggctccaacctttgtggatactccatgcagggtctttgcaaattcggtctttatgaagtattcaaagtattgactctgacatattgggagaag

SEQ ID NO: 2253 - DNA, 494 bp, Ctenocephalides felis
tgccaaaaaataaaacaatttaaaaacgaaaatggtctcgacgaaattgtgtttgcaatttttgattgttgcatttgtcggatatacgacgagtgcccaacaatacacatgtctaaccgatggcgaaaaagaaaccacaacatgcaaactcatcaacgaatgttacgtaatttacaacacaaagtcaggaaccaccaactacggttgcctaatcaagatgacgaattcccaaagaaactactgtgccaaaaatccacacatgtgcataacttgcactggaaataattgcaataccaaagatttgatgaaaatgtgcatcacttgcacctccaaggaggacgagagatgcaccaccgatcctcagcaattggctaaaacttctgtcaggccttgcaatggtgattgcattacacatgtccttccagatggtacaaatacaaggggttgttgaaaccaactgatgactgtgatgatatgaaatgcaggagtgcaaa

SEQ ID NO: 2254 - DNA, 495 bp, Ctenocephalides felis
atcaggagaaatatattgatagtgtgtagtttcgtgcaattaaattgtgtcaaatttcaaatctaccctgccaaaagggccacattgattatttaaagtccctcgcactcacacgcacggcaccactatgtctacggtcgacaaggaagaattggtgcaacgagccaaactggcagagcaggcccgaaagatacgatgatatggctgcggcgatgaaggctgttacggaaaccggtgtggaattatccaatgaagaaaggaaccttttatctgttgcctataaaaatgtggttggggcgcggcgttcatcatggcgtgttatctcctccatcgaacaaaaaacagagggttccgaaagaaaacaacagatggcaaaggagtatcgggaaaaagttgaaaaggaacttcgtgaaatttgttacgacgtactgggccttcttgacaagtaccttattcctaaagctagtaatgccgaagtaaggtttctatcttaag

SEQ ID NO: 2255 - DNA, 486 bp, Ctenocephalides felis
tataatatataacaatgcaacgaaaaaaaatagcatttgggaaaattggatcaaattttatgaggggatctgaaaaccgaaatgatattgttatacagaatggctttggaaaatttgggggcaccagcactaattccgttgaaactgaaagtattccacaggatcctgaaacgcaaaaagttaaagaaactatgggaattccgggtttggccgcaaagcaaaaacttttgatgtagaagaaatggtgaagcaaattcatcaaactgttagagataaaactaaagatataattaaagataatactaaagatgattctgaagaagagagtgatattgtaggtcccttaccttccaatttaacatctgaaaatgctgataaaactgtggaatccgataaaagtgaagacagttatgatgatttaagtgactcagatgaagatgattctaatgaaaaacttttaataaaccgatcctttatccatgaggt

SEQ ID NO: 2256 - DNA, 494 bp, Ctenocephalides felis
  misc_feature (29)..(29): n = unknown
tatatcgggtcgagtttgcaaaagagttntatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggagccacatcattgtgcttcgtctacccacttgattc

SEQ ID NO: 2257 - DNA, 485 bp, Ctenocephalides felis
actcacaaatgatgtgtccatcataaaattggtcgatgaaggagtagatcttaaacctggtaccttgttaactgttactggatggggatcaactggaaatggaccttcaaccaatgttttgcaagaagttcaagtaccacatgtcgaccaaaccacttgctccaaatcttacccaggaagtttgactgatcgtatgttctgcgctggttatttgggacaaggaggcaaggactcatgccaaggtgattctggtggcccagttgttgtcaatggtgttcaacatggaattgtctcatggggtcgtggttgtgcacttcctgattatcctggagtttactctaaaatctctaccgctcgcagctggatcaaggaagtgtctggtgtttaatttattcttgaaatctctattttgtattatttatgtatatagtaagagttgtaaatataaatagttacatctaatctaaaaaaaaaaaaaaaaaaaa

SEQ ID NO: 2258 - DNA, 500 bp, Ctenocephalides felis
attttttaacaaaatgaaatctttgattttaactcttttaatttttggaccattagtgtcttcaggtttcgtgatcgacgcccaaaacaatggaattgacaatgaatatgaaataaatgtcattttatttgctactgaaagtgagttgcttgaaaagtaccctcatgcaaagaatcttgagttggagaaagaagaattatttacgggaagagttcaactcacgtatactttaggaaaccgagtgccgggagatcggcttgtagccattggaaccgattcctattcttggccagatgcccgagacgttaagctggaattgacctaccccacttctggaaatggtgcggttgtgtcttaccttcttataggaatcgttcaagatcaaatatcggcaatgcctatgttgttagtggaggaataggacaaagaaggattgttattgtgtcaagctgtcacacgacattcttgagctataatgctcaaattatggacgataagtg

SEQ ID NO: 2259 - DNA, 178 bp, Ctenocephalides felis
  misc_feature (127)..(127): n = unknown
  misc_feature (173)..(174): n = unknown
gcaggccagatatttttgtgaaagtgcgagatttccaatcctggattaattctgaaattgaaaaaaattaaatagattccaatcatgatttgttataatgaaaaatggtttaataaaggcagcatantttaaaaaaaaaaaaaaaaaaaaaaaaaaaaaaaaaaaaaaaaaannaaaa

SEQ ID NO: 2260 - DNA, 500 bp, Ctenocephalides felis
atctttttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgccaaaatggcttgccgctggagagaagccagggagaacgccgaagccctcagagcacaagccaaggagtgcgttgtgaccgcagccgatgtcgatgaagccagag

SEQ ID NO: 2261 - DNA, 500 bp, Ctenocephalides felis
caggttcagagtgtgttttaaaacgacaaataaccaaaggagccaaaatgcctcaagaacttaataaaatctcggatgaagagcgagagggaaaattcggctatgtatacgccgtttctggtcctgtcgtaacagctgaacgtatgtcaggatcagctatgtacgaattggtaccgtgtaggatactatgaacttgtcggagaaatcattaggttggaaggtgatatggctactattcaggtatatgaagaaacatcaggtgtaactgtaggtgaccctgttctaagaacaggaaaaccattgtccgtagaacttggaccaggtatcttgggaagtatctttgatggtatccaacgtccacttaaagatattaatgagttaactcaatcgatttacattcccaagggtgttaatattcctgctctgtcaaaaacacagtcctgggactttgatccaatgaacattagaattggatcccatattactggaggagattgtat

SEQ ID NO: 2262 - DNA, 496 bp, Ctenocephalides felis
  misc_feature (414)..(414): n = unknown
tataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgncgctggagagaagccagggagaacgccgaagccctcagagcacaagccaaggagtgcgttgtccgcaccgtgtcgatgaacc

SEQ ID NO: 2263 - DNA, 500 bp, Ctenocephalides felis
  misc_feature (34)..(34): n = unknown
cggtttagtgcatataggaataaaatactagttntattgccattaatatttgaaaaatatcattgagaaaatgtcaatattattatgcgcgctattttttgcttcgacgcttagcaatgaaactttgtcgaaacaccatcaagttaagaatcgtcgattttacatagattatgataaaaatacattcatgatgggatgacaaaccatttcgatacatagcaggttcattacattattttcgggtacatccgcaacaatggaaagaccgtttggaaaagctaaaagcagcaggtttaaatgccgttgatacatatgttgagtggtcacttcacaattttgatgaaggaaaatattggtggggcagcaacgccgatttggagcaatttattaaaactgcacaagaagtaggattgtatgtaattttgagaccagggccatacatttgcgctgaacgtgattttggaggccaaccttattggctcttatcacacccagaaaaa

SEQ ID NO: 2264 - DNA, 500 bp, Ctenocephalides felis
cttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttggccgctggagagaagccagggagaacgccgaagccctcagagcacaagccaaggagtgcgttgttaccgcagccgatgtcgatgaagccagagcttgcttgaaagatgtcttcaagctgccgtgaaggaccaaggacttggcaaggctttcaaagaacctgtc

SEQ ID NO: 2265 - DNA, 455 bp, Ctenocephalides felis
ccaaaatggcttggccgcctggagagaagccagggagaacgctgaagcccttagagccgaagctaaggagtgcgttgtgaccgcagccgatgttgatgaagccagagcttgcttgaaaggggttcttcaagctgcccacgaaggagctaaagacttggccaaggcactcaaagaaacctggtcccaattgggtaacttagtccgcgaagtcggaaaatgcgcaaggggagccttgaaagaattcagggataacttggttcaagtccgtaaagactgtgctgactgcttaaaacttactgataactaaattattttaagaattttataaccaactgtaaattatctataaacgttttaagattatttagtcgtatttgtggtgcaatgaatttagttttttatgtagtattttgacaaataaaaattatttataaaaataaaaaaaaaaaaaaaaa

SEQ ID NO: 2266 - DNA, 505 bp, Ctenocephalides felis
tctgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgcaaaatagattgcgacctcgatgttggattaagataattttaaaatgcagaagttttaaaatttggtctgttcgaccattaattcttacatgatctgagttcaaaccggtttaagccaggttggttctatccttaatttttaaaattaattagtcgaaaggccattaatttataataattatttaattgaataaaataaaaaaaaaaaaaaaaaaaaaaa

SEQ ID NO: 2267 - DNA, 500 bp, Ctenocephalides felis
gttcttcagatatttactaaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaaccctcagagcacaagccaaggagtgcg

SEQ ID NO: 2268 - DNA, 381 bp, Ctenocephalides felis
ttttactaaattttaatatttgtataccgttgtcgaaagaatatttttaaaaaaattaaattttcaaaaatttaaaataaaatttatgtcaaatcaaggtgcagtttataatttagaagaaatgggttacaataaatttatttaaatggattttatattgaaaaatattaataaaggtggatttaatagtaaattaattttaatataattaattgattaaagttctaaaatatgtacatattgcccgtcgctctttttaatttattaaaaaaagataagtcgtaacatagtagatgtactggaaagtgtatctagaaagaaaaaaaaaaaaaaaaaaaaaaaaaaaaaaaaaaaaaaaaaaaaaaaaaaaaaaaaaaaaaa

SEQ ID NO: 2269 - DNA, 494 bp, Ctenocephalides felis
atgttgcacttttacggatcaaagagccaatatcatttactccatgcacagtaactcctgtaaaattaatacaatcgggaaaagaagtaccgaagggaacaactttgagtgtaactggatggggcgccacgaaggaatgggggccaatttcgccaaagttacaagaagttaaagttaaagcttactcaagtcaagaatgcaagaacagtcatgctattaacagtgacatcatttctgacagtatgatgtgcgctggttttcctcaaggacaaaaagatacttgtcatggggatagcggtgggccacttgtagatgaaaaacaggttcaagtaggagttatatcctggaggcgaggatgcgcgcgacctggatatcctggcgtatatacaaaattgagcccccggaaatccaacagtttattaaaaacaatgtaaaactttaaatcataaaactgatgaaaatcaacaataaacaattacggaaaataaaaaaaa

SEQ ID NO: 2270 - DNA, 496 bp, Ctenocephalides felis
ttagaagctttattggttgcagtgtttgccttgggtgctgtggctgctgacaggaattcgcccacatatgtccgcggtttcccagtgggaagatccagagcacgaacaacatttggcaatgaagaaataaagtgtactaataagcagttgggaacattttgtcacgattgttctactttgaagttgtgcgctggacaagaaaccccaattacaacaatcaattgcagagactcaaattccgatgctccattttgtgtagatgatatgtgctcatcaaaacctggggaaaactgtaagacggcagaaactacatgcgcggttgtaggatatcagccagatccgaaagactgcacaagatacttattctgcaaagatggtaaaggtcaggttttcgaatgcccacctaactatgtatatgatcattctaaaaattgtgtaaaaagaaatcgtcagaagctgattgcaccgcatgaaatgcacaaatccaattctttta

SEQ ID NO: 2271 - DNA, 494 bp, Ctenocephalides felis
tccaaataataggattgtcaatggaaatgatgctaaagaaggacagtatccatatgttgtatctttacgtggacccactggaggccacacctgtggtgcctccattattaacagactctggattttgactgcagctcattgtgtttatggaagagaagacttagatttttcggttcaatatggagtcaccaaaatttcacaaaaaggtgatactgtagttgatgttgatgaaataattgtacacaaaggttataatcctagtaacagttatatcaacgacattgcacttctcaagctatctgaacccttaaaatatagtaaatttgcgcaaccagttactttgccagaagccaatgaacaaactaaacacaatgcatcagctactcttgtcggatggggaataaattctactaccgacggagttttacaaacacatctccaagaattgcactaccagatcgtcggatccaaggaatgtggtgatttgcacttta

SEQ ID NO: 2272 - DNA, 496 bp, Ctenocephalides felis
tttcattggtgcttctaatccatcactggaacaaactgaaacccatccaaactcaaattctgtagaagctgatgcactcataactccaaaaaaatgtagtaatcaaaaaaggcaatttagcagagttccttcttattatgataaattaaattcctggcttggtcagattttgcagagagatgctccgcaggtacccctggaaatatgtgatttagatagcgctggtattgtgttaagatactgcccattagaagctgctccaggaggtcctcctgaggcaagagatctagaagagtttgccgtttgtgttgaacagcaattagaaattttagaggctaccataaaacataaagaaacatttgtaagacttgttgagcagagtccagttttgaaactagttgaactgcaggatgggctggtctgggtggggttcgctatgcaccaaaggttgggaagcattattaacagatcaagctaaatcagaattaaataagtt

SEQ ID NO: 2273 - DNA, 496 bp, Ctenocephalides felis
  misc_feature (463)..(463): n = unknown
cccactcgccaaattacaccatggctgaaccagaaaaggctcctgaacaaccaaaggtgcccgcacagaagcaaatcatcgcttcgaaggtgatgggaactgtgaaatggttcaatgtcaaaagcggatatggatttataaatagaactgacaccaaggaagatgtgtttgtacatcaatctgccatagttaaaaacaacccgaagaaggctgtccgcagtgtaggggatggagaaactgtggagtttgatgtggtaattggagagaagggaaatgaggcagctaatgtgaccggcccagaaggagagccagtcaagggaagcccatatgcggccgacaaacgccgcagctatcgccaatggagctaccctcgtggaggacccaggggacccagaagaaattacgaaggaggcgaaggtaaagaagggtcgggttcgggaggcgagaacggtgatggcaaggnccgtacaaggaggcggccccgcgtggccgttcc

SEQ ID NO: 2274 - DNA, 485 bp, Ctenocephalides felis
gatatttactaaatattgtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacccgaaccctcagagcacaagccaagga

SEQ ID NO: 2275 - DNA, 500 bp, Ctenocephalides felis
attttttagaatgttttatatcacattggtttttattagttttgtggcgttatctgtcgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaattaaatgattgcaaagctattattattgtgacgaaaatagtataggaacccaatattattgcccgcaaatttgcatatgatccgtacgt

SEQ ID NO: 2276 - DNA, 535 bp, Ctenocephalides felis
ttcatgtctttttgaaaataatataaagtctaatctgcccattgaagatttaaaaggccgcagtaatttgactgtgcaaaggtagcataatcaatagttttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccgg

SEQ ID NO: 2277 - DNA, 496 bp, Ctenocephalides felis
ctcacctgtaaatatttttatgccataatatttttgaatacataaaagtaaaataataaagtgaaaatgaagacaaaaaatattctcttttgtttaactattggattagttatgctgagcctttgtgcagaagcagaagcaagacgtaagattctcagaggccgacaagttataacaagaacttataacaaagggttggccgttcctgcctggtcgattgttctaatgtgtggaataggaatgattattctggggggattattatatgttgcaatgtacaaaatgattttatcagaaagtaaaagtgaagacataaatatgataccagtttacacagcagctgcaacaagagatgatgatgaatcttgaacgtcaataaataaattatatatatatatatatatatatatatatatatatatacttaaaaaaaatatactatttaatttatgtattggaatgactagatacaattatatatagcttattaaaaaaa

SEQ ID NO: 2278 - DNA, 479 bp, Ctenocephalides felis
ggggttcaacccgcttattttgtatcaaggagcgggtgttgaataggccacatcatgggggctatgtttcgaagtgaggagatggctttatgccagatgtttattcagcctgaagctgcttacacttcagtttcagaattgggagaagctggaaccgtccaatttagagacttgaatgttgatgttaattcatttcaacgtaaattcgtcaacgaagtcaggcgttgcgatgagatggagagaaagctccgctacgtagaaacagaaattaacaaagacaaagtgtctgtaccagatgttcaagacgttccccatgctcctaatccaagggaaataatagacctagaggcacatttggagaaaacagaaaatgaaatcatggaactgtcccaaaatgcagtcaatcttaaatccaactttttggaattgacagaactcaaaaacgttctagaaaaaacacagagcttcttcgtggagca

SEQ ID NO: 2279 - DNA, 543 bp, Ctenocephalides felis
cagctgctgatatataccaaataaagtttgtttgtgagaaaaagtatttgcataatttggattatttccactatatcagattactcatttgaaccatgtctctcgtaccattgttgtttcacgactggtgggaggattacgaccacccaatgcgtcttatggaccaacattttggaatgggcctaaatcgtaatgatcttattactaatctaagggccactccatcactcttccgtggcggttattacagaccttggaggaatgaaattactgctgacgattcttcatcaactatcgttgctgacaaagataaattccaagtgactttagacgttcaacaattcaaaccaaaagaaatcaccgtaaaaacaaaggacaattgcgtaatcgtcgaaggcaaacacgaagaaaaacaagatgaacacggatacatttcccgtcattttgttcgacgatatgtcttgcccagaaatcacgatgctgccgatgtagtatcgagtttgtcctcggatggagtattgaccataacagcgcccaagaagg

SEQ ID NO: 2280 - DNA, 534 bp, Ctenocephalides felis
  misc_feature (475)..(475): n = unknown
ttttattagagctccgaagtgctcttactatatttgttatagtcatatatatttaagtatattgaagaattgaaccgatggcaagcccagttgtgcgaaaatcgaacaaggacgaagtaaataaagaaattgtcagtatggatgaagtagctaaagatgctaaaaattttattgaacgcattcttggggatgtgagcaaaacctcagcaactaaacaattagtcattggttcattatcaggatggacaactggatttgttactatgaggattggtaaattggctgctcttgccgttggcggtggtattttaatattacaagtagctaaccacaaagggtacatttctattgactgggataaagtaactaaaaaggctgataaggtgacagataaaattgaagaggctgttactggagaaactcccaaattaatggataaagtcagaatttttacaagagagaatccttatattgnaacttcttttattggtggtttcttcattggattatcatgttaaccatgctatagcattg

SEQ ID NO: 2281 - DNA, 539 bp, Ctenocephalides felis
cttggtgcaatgacaaattgcaaccgatcgtactgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatcacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttattgaaattaaaaaaaccaaaaaaaaaaaaaaaaa

SEQ ID NO: 2282 - DNA, 549 bp, Ctenocephalides felis
aataacttcaagttttgtctgcaatatataaaaatttaagatggctaaagcaccagcagttggtatagatttgggtactacgtactcctgcgtgggtgttttccaacacggaaaagtagaaattattgcaaatgaccaaggaaacaggactactccttcatatgtcgcgtttaccgatacagagcgtctcatcggagacgccgccaagaatcaagtggccatgaaccccaataacacaatttttgatgccaaacgtcttattgggcgtaaattcgaggaccaaacagtccaagctgatatgaaacattggcccttcgaggttgtcagcgatggaggtaaaccaaaaattagagtatcgtacaaaggagaatccaaaaccttcttccctgaagaagtcagttccatggtgttgactaaaatgaaggaaaccgctgaagcttacttaggcaaaactgtgaccaatgctgtcgttactgtcctgcctacttcaatgactcacaacgtcaagccaccaaggattcgggaactatctccggtctgaatgtgttg

SEQ ID NO: 2283 - DNA, 543 bp, Ctenocephalides felis
ttcagttcgagtcggcaccagtttccaaggaagacgtggttccgttcatcctgtggcacaaattatcaagcatcctgcatacggtaatgtaactgacatcgatatggatgtcgccctcatcaaggttcgaagaccattccggttgaataacagaactgttagaacagtcaaacttactgatgttggaaaagacatgccatcaggagaattagccactgttactggctggggaaatttaggggaagatgaagacgaccccgaacaactgcaatatgtaaaggtacctattgttaactggactcagtgcaaaactatatatggaaatgaaggactaataattacccaaaatatgatttgtgctggttatcctgaaggcggtaaggactcttgccaaggagatagcggtggcccactcgtcaactctaagggagttctgcatggaatagtgtcttggggaataggatgtgcacgacccgaaatcccaggagtatatacccgagtggcttcaaaaccaataagagaatttatcaaaatgcacactgg

SEQ ID NO: 2284 - DNA, 545 bp, Ctenocephalides felis
ttaaaattgttttttctataaaaatagcataatttaggaaactatatcgaaaaaataataaatttttaagtggccctttaatatcttctagaattaaatatggcaaccgtaccccttatgtttgctgaagatgacctagaaggtggtggaaaagaaggttcaatcgagaatgactttgcatataacaataacgttattaatgcatctgttcgtgtgagacttggattcattcgaaaagtctatggactacttaccgttcagttgttattgagcttgctggtgggcatagcctgccaaattgagcctgtacaaggaattgttaaagcaaatgactggctcgtattagtctgcatgatcagtagcattggtgtgctggttgctcttcatatcaagagaaaggaaacaccaactaattttattctgttaacaattttcacaattacaaactccatcagtgtgggtgtgctagtaacacattttaaagctagtttagtacttcaagctattgcaattactttgtgtgttggtattggtataacactctt

SEQ ID NO: 2285 - DNA, 542 bp, Ctenocephalides felis
aataattgataaatttatttataaatcatcataattcgatataatttacaaaatgcgtgctttgacttttattttgttcagctgtcttttgtttgctgcttttgtccgttgcgatgacgaagctgctgaaacagatcaccatccagttggtcctgaatcctgcaccaaagaaaacgaggaattccaaccatgtggaacaagttgtccagtaacctgtgcaaatcatttggacaaaactccgaaaccatgtaccctgcaatgtgttattggatgtcactgtaaagctggatttgtcaaaaatgatgaaggaaattgcgtaaaagaagaagattgtcctaaccatccatctggggatcatgaacaccatgaaggggatgatcatgaacaccatgaggaaaaacatgaggaccatgaaaaccatgatgaaaaacatgaaaaccatgagaaccatgacgaaaatcatgaacaccacgagaaccatgatgaaaaccatgaacaccatgattaaattgtagatgagaggtatttgaatcaaaaacgtg

SEQ ID NO: 2286 - DNA, 543 bp, Ctenocephalides felis
tgctatgggtgaattcttccgtgacaatggaaaacatgctttgatcatctatgatgatttatctaaacaagctgttgcttatcgtcaaatgtctctattgttacgtcgtccaccaggtcgtgaggcttatccaggtgatgtcttctaccttcactcacgtctacttgaacgtgccgctaaaatgtctgaagctcatggaggtggctctttgactgctttgccagttattgaaacacaagctggtgacgtatcagcttatattccaactaatgtcatttccattactgatggtcaaatcttcttggaaactgaattgttctacaagggtattcgaccagccatcaatgtaggtttatctgtatctcgtgtaggttctgctgcacaaaccaaagccatgaaacaggttgccggttccatgaaactggaattagctcaatatcgtgaggtggctgcttttgcccaattcggctcagatcttgatgcagccacacaacaattggtaaacagaggtgttccgtttgactgaattattggaacaaggac

SEQ ID NO: 2287 - DNA, 542 bp, Ctenocephalides felis
gaaggacagtatccatatgttgtatctttacgtggacccactggaggccacacctgtggtgcctccattattaacagactctggattttgactgcagctcattgtgtttatggaagagaagacttagatttttcggttcaatatggagtcaccaaaatttcacaaaaaggtgatactgtagttgatgttgatgaaataattgtacacaaaggttataatcctagtaacagttatatcaacgacattgcacttctcaagctatctgaacccttaaaatatagtaaatttgcgcaaccagttactttgccagaagccaatgaacaaactaaacacaatgcatcagctactcttgtcggatggggaataaattctactaccgacggagttttacaaacacatctccaagaattgcactaccagatcgtcggatccaaggaatgtggtgatttgcactttagacccatttataaagagcaaatttgcgcagcttatccagattatgacagagcacaatgcagtggagattctggaggtccattgac

SEQ ID NO: 2288 - DNA, 549 bp, Ctenocephalides felis
atattagggcggattatgattttgacgttgctgtactagaacttgaaaaaccagtctcatatacggtttgtacagtagtatcagtagatttagccgaaagtggaactgaagttaaacctggagcaatacttagtgtcactggatggggtgcaactaaggaaggtggcggcggaactttgcaactacaaggtgtgaaagttccagctatctctcccaaagattgtgctaaggggtatccaccttctggaggtaaagacaaaattacagacagcatgttatgtgctggtcttcctgaaggaggtaaagattcctgccaaggcgacagtggcggtccactggtagatgaaaatagaaagcaagtaggagtggtttcttggggtcaaggatgtgccagaccaggaaaaccaggaatttatgctaaagtgtcacaccccgaaatcagaaaatttattgaaaaatatgctaatgtttaagtggattttattttcaatataatgtgatttaagatactctttaatgttatgtaataaattgtgataaattaaataa

SEQ ID NO: 2289 - DNA, 536 bp, Ctenocephalides felis
  misc_feature (498)..(498): n = unknown
taaatattgtgaaataaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgcctggagagaagccagggagaacgccgaagccctcagagcacaagccaaggagtgcgttggtacccgcancgatgtcgatgaaaccagagctttgcttgaaagatgtc

SEQ ID NO: 2290 - DNA, 543 bp, Ctenocephalides felis
taaatcattttcaaaatggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttggccgcctggagagaagccagggagaacgcccgaagccctcagagcacaagccaaggagtgcgttgtacccgcagcccgatgtcgatgaagccagagcttgcttgaaagatgtcttcaagctgcccgtgaagg

SEQ ID NO: 2291 - DNA, 543 bp, Ctenocephalides felis
caaaggtatcatcgattgctttgtacgtatccctaaggagcagggcgtactttccttctggcgtggtaacttggccaatgtcattcgttatttcccaactcaggctttgaactttgcattcaaagacaagtacaagcaagttttcttgggtggagttgacaagaagacccaattctggcgttacttcgcaggaaacttggcatctggtggtgctgctggagccacatcattgtgcttcgtctacccacttgattttgcccgtaccagattggccgctgatgtaggtaaaggcgctggtcaacgtgaattctctggattgggcaactgcttgaccaaaatcttcaagtctgatggtctccctggattgtaccgtggttttggagtatctgttcaaggtatcatcatctaccgtgcagcatactttggattctatgacaccgctcgtggaatgttgccagaccccaagaacaccccattagttatcagctgggccattgcacaagccgcacaactggtgctggtattggtcatatccattcgaca

SEQ ID NO: 2292 - DNA, 541 bp, Ctenocephalides felis
  misc_feature (28)..(28): n = unknown
  misc_feature (511)..(511): n = unknown
ctgtgcaaaggtagcataatcaatagtnttttaattgaaagctggaatgaatgattgaatgaaatattaactgtcttaataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgacccattaattcttacatgatctgagttcaaacccggtttaagccaggttggtttctatccttaatttttaaaattaattangtaccgaaagggccaattaatttataataa

SEQ ID NO: 2293 - DNA, 542 bp, Ctenocephalides felis
gatggtacatactacgacgtcgaacgttttgtgatgcatgataaatatacaccaagaatcactgtcaactatgctgatattggtctaataaaagtggcaaaagacattgtattcggtgacaaagtccaaccgatcaaaattagcaagagaaacatcaagggtggtgaaatttgcaaggcaactggttggggtctattaggttctgtggactcagtaccaaacgaattacaacaagtagaaaccactgcaataacagacgaaaagtgctttgaattgactcaattcattgacccaacttcgcaaatatgtacattcagggaatttggtagaggcatttgctttggtgattctggtggaccactagtttacaaaaatgaacttgttggcattacatcgatgcacttatactcctgcagaggtgggcaggccagatatttttgtgaaagtgcgagatttccaatcctggattaattctgaaattgaaaaaaattaaatagattccaatcatgatttggtataatgaaaaatggttaataaaggcg

SEQ ID NO: 2294 - DNA, 543 bp, Ctenocephalides felis
  misc_feature (488)..(488): n = unknown
aggctcggctccgtaccaagtttcattgagaaatcagaatctggagcatttctgtggtggttccattttgaacaaacgttggattgtgacggctgcacattgcctaaaacccggcattttaaaatctgtctatttgggatcaaactcattagatggcaatggtacatactacgacgtcgaacgttttgtgatgcatcataaatatacaccaaaaattactgtcaactatgctgatattggtctaataaaagtggcgaaagacattgtattcagtgacaaagttcaaccaatcaaaattagcaaaagaaatatcaaggatggtgaaatctgcaaggccactggttggggtcgattggcggatggggccccagtaccaaacgaattacaacaagtggaaaccactgtaataacaaacgaaaagtgctacgaattgtctcaattcgttgaaccaacttcgcaaatatgtacattaaaagaatttggaagangcatttgctttggtgattcttggtggccactgggttacaaaagatgaactgggtg

SEQ ID NO: 2295 - DNA, 537 bp, Ctenocephalides felis
  misc_feature (14)..(14): n = unknown
  misc_feature (27)..(27): n = unknown
  misc_feature (52)..(52): n = unknown
  misc_feature (175)..(175): n = unknown
  misc_feature (180)..(180): n = unknown
  misc_feature (199)..(199): n = unknown
  misc_feature (202)..(202): n = unknown
  misc_feature (349)..(349): n = unknown
  misc_feature (430)..(430): n = unknown
  misc_feature (443)..(443): n = unknown
gtattctatagtgncacctaaatagcnggggcgtaatcatggtcatagctgnttcctgtgtgaaattgttatccgctcacaattccacacaacatacgagccggaagcataaagtgtaaagcctggggtgcctaatgagtgagctaactcacattaattgcgttgcgctcactgncccgnttccagtcgggaaacctgncgngccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggntatccacagaatcaggggataacgcaggaaagaacatgtgagcaaaaggccagcaaaaggccaggaaccgtaaaaaggcgngttgctggcgttntcatagctcgcccctgacgagcatcacaaaaatcgacgctaagtcagaggtgcgaacccgcaggactataagataccaggcgttccccctggag

SEQ ID NO: 2296 - DNA, 549 bp, Ctenocephalides felis
ggtgtccaaagtgtttgtcgttcttgccatcattggctttattggggctgcccaagccttcttcgatcaagatgccgtcttagataagatggtagatgacatctctgctgaatatgaaaacagcattgcaagaattagccaagatagcaaaattgaaatgattgctgctgaattcgaaaaacaaggatttgcccctgaagtcgatagagatttggaaaggttcaacaaagaagttgaaaggaaacttagcaaaaaagtgagtgaagccgcaaaggaatgccttaaaggccaacaccaaaaagctctaggttttgcacaagaagctcgtgctaaggtcaaggcttgcagggatgataaacgtgaggaattcaaccaagttcgccaaaatggcttgccgctggagagaagccagggagaacgccgaagccctcagagcacaagccaaggagtgcgttgtccgcagccgtgtcgatgaaccagacttgcttgaaagatgtcttcagctgccgtgaaggaccaggcttgccaagcttcaaagaacctgtccaa

SEQ ID NO: 2297 - DNA, 549 bp, Ctenocephalides felis
  misc_feature (294)..(294): n = unknown
  misc_feature (521)..(521): n = unknown
gtttaatccgtattttaagtgatttttcataatgaagcttatcagcatcattttctgcttagcattcacctctgcttggggatttagaatacctagttacatatggccatgggcccaagagaacagaattgtcgggggacaaactacccaaattaatgaaagaccttatcaagtatcaagtttgagatacaatcaacataattgcggaggtgttattttaaataaagaatatgttcttactgcggcacactgtttcaatgatgtaactcatcattcggaaattcaagtcagagntggaagtacaaatgcttatcacggaggaataatcgtggatgttgaggacattacagtacacgaactttataatgaaaagttcacaaattatgatgtagctgttgtgaaattagcttatccattaagatttgataaaaatataaaagcagcggtctggcagaggatggatatgagccagaaataaattctaaggcactgatccggatgggtagtttgagctccttggnctcccagaagagctccacaggtagattg

SEQ ID NO: 2298 - DNA, 544 bp, Ctenocephalides felis
tgtggctgctgacaggaattcgcccacatatgtccgcggtttcccagtgggaagatccagagcacgaacaacatttggcaatgaagaaataaagtgtactaataagcagttgggaacattttgtcacgattgttctactttgaagttgtgcgctggacaagaaaccccaattcaacaatcaattgcagagactcaaattccgatgctccattttgtgtagatgatatgtgctcatcaaaacctggggaaaactgtaagacggcagaaactacatgcgcggttgtaggatatcagccagatccgaaagactgcacaagatacttattctgcaaagatggtaaaggacaggttttcgaatgcccacctaactatgtatatgatcattctaaaaatatgtgtaaaaagaaatcgtcagaagctgattgcaccgtcatgaaatgcacaaatcccaattttttataacctatgcaccggcccatcaatttatgcttggtgcaatgcaaattgcaccgacgactgaatgtgaagacacgtcaacgaatgg

SEQ ID NO: 2299 - DNA, 544 bp, Ctenocephalides felis
  misc_feature (542)..(542): n = unknown
gtcgacgacagaggatagaagtcagaggacatttataatacgcagtttttaagttttttctggtgattttgaatatatttggagaaaatgaagaggattttggttgctttggcggttttggtggtcgttgctgaggctaagctgtcatgttcgagtacaaaagcctcgatccctgaagaatggatcgacatgacagcccagtgcacgaggagcatgaggaaccagatccaagaagaactgagtgcttcgatgcaatacttggccatgggggcacacttctcaagagacactgtcaacaggccaggatttgctgagatgttcttcaaatcggcaagcgaagagagggagcatgccatgaaactcatgtcttacttgatgatgagaggagaactgaccgagaggctgcaggacttgatcagaacccaactgttcaatcacacttggctgatggtttgagtgctttgaaagatgctctgaaattggagcttccgtcaaagaagataaacatgttttaaacttgcagacgatatggactacatttnat

SEQ ID NO: 2300 - DNA, 541 bp, Ctenocephalides felis
  misc_feature (509)..(509): n = unknown
tttttgtgtcaatttgcagttttagtagttattttatttagaaatttgttataaatcaaatcagcaaccatggctttaagcgatgccgatgtacaaaaacaaatcaagcacatgatggctttcattgagcaagaagccaatgaaaaagctgaggaaattgacgcaaaagcagaagaggaattcaacattgaaaagggacgattggtacagcaacagcgactaaagattatggaatactatgagaagaaggaaaaacaagttgaattgcaaaagaaaattcaatcatccaacatgctcaaccaagctcgattgaaggtattgaaagttcgtgaagatcatgtgaggaatgttttggatgaagcccgcaaaaggttgggagaagttacacgtaataaggaacaatacaaagaagttttaacaccttattgtcaaggatgtccacttatggagcccaaagtttattgaagtccgcaagctgattagattggtagaatcagtttaactgtgcntggtcatttaacaccgatggtaccaagaagtg

SEQ ID NO: 2301 - DNA, 419 bp, Ctenocephalides felis
  misc_feature (41)..(41): n = unknown
  misc_feature (116)..(116): n = unknown
  misc_feature (128)..(128): n = unknown
  misc_feature (174)..(174): n = unknown
  misc_feature (197)..(197): n = unknown
  misc_feature (211)..(211): n = unknown
  misc_feature (260)..(260): n = unknown
  misc_feature (273)..(273): n = unknown
  misc_feature (294)..(294): n = unknown
  misc_feature (308)..(308): n = unknown
  misc_feature (317)..(317): n = unknown
  misc_feature (321)..(321): n = unknown
  misc_feature (331)..(331): n = unknown
  misc_feature (345)..(345): n = unknown
  misc_feature (384)..(384): n = unknown
  misc_feature (386)..(386): n = unknown
ttttttttttttttttttttttataaacaatttttatttgncaaaaagctacataagctagaaccattagaccacaaataatatatcactagacatttttaggaagtttacagttngttatacaattnttaaactaatttagttatcagtaagttttaagcagtcggcacagtntttacggacttgtactaagttgnccctaaattctttnaaggctccccttgcgcattttccgacttcacggactaagttgcccaatngggaccaggtttntttgagtgccttggccaagtnttttgctccttcgngggcagctngganaacccctttnaagcaaactctggnttcatcgacatcggctgcggtcacaacgcactccttggntngtgctctgagggcttcggcgttctccctggctt

SEQ ID NO: 2302 - DNA, 336 bp, Ctenocephalides felis
ggtttccactgcaataacaaatgaaaagtgctacgaattgtctcaattcgttgagccaacttcgcaaatatgtacattaagggaatttttaagaggcatttgctttggtgattctggtggaccactggtttacaaaggtgaactggttggcgtttcttcgtttgtcttgtacacttgcggagctggacgcccagatgtttttgttaaagtgcgtgatttccaatcttggatcaattctgaaattagaaaaaaataaatagatttcaatcatgatttgttgtaataaaaaatggttaaataaaggcagcataatttaaaaaaaaaaaaaaaaaaaaa

SEQ ID NO: 2303 - DNA, 549 bp, Ctenocephalides felis
gttcttagaagctttattggttgcagtgtttgccttgggtgctgtggctgctgacaggaattcgcccacatatgtccgcggtttcccagtgggaagatccagagcacgaacaacatttggcaatgaagaaataaagtgtactaataagcagttgggaacattttgtcacgattgttctactttgaagttgtgcgctggacaagaaaccccaattacaacaatcaattgcagagactcaaattccgatgctccattttgtgtagatgatatgtgctcatcaaaacctggggaaaactgtaagacggcagaaactacatgcgcggttgtaggatatcagccagatccgaaagactgcacaagatacttattctgcaaagatggtaaaggtcaggttttcgaatgcccacctaactatgtatatgatcattctaaaaattgtgtaaaaagaaatcgtcagaagctgattgaccgcatgaaatgccaaatccaattctttatacctatcaccgacccatcaattatgcttgtgcatgacaatgcaccgtcgac

SEQ ID NO: 2304 - DNA, 549 bp, Ctenocephalides felis
gtttgccgtgcgtgtacataatatacgtgtgatttaggttgttaggaatatttaataattaaactgtcttaagtaaaaacaaatccacaaaatggcattgatgcgttgtatttctgcgaacaagttggcggagtcacaccataaagtgatccccatcatcgccaccgctattagacacttatcagcagaatctactgatctcaaagcagttttagaaaaaattatacctagagaacaacaaagagtcaaagaattccgtaaatctcatggagccaccaaagtgggagaagtcaccgttgatatgatgtatggtggtatgcgtggtattaagggattagtctgtgaaacttcagtattagaccctgaagagggcatccgtttccgaggcttatctatcccagaatgccaaaaagttttacccaaagcaccaggtggcgaagaacctttacctgagggtctttttggtattaatcaccggtgaagtccaccgagctaagttaaagcctgcaaaggaatgggctaccggcccataccactcatgtagtcagt

SEQ ID NO: 2305 - DNA, 545 bp, Ctenocephalides felis
  misc_feature (473)..(473): n = unknown
  misc_feature (521)..(521): n = unknown
tgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgctgcagtctctaagactgtggtggcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcaggaaacttggcatctggtggtgctgtggaccacatattgngctcgctacccacttgattcgccgtccagatggccgtgatgaggtaangcctgtcaacgtgatcttggatgg

SEQ ID NO: 2306 - DNA, 461 bp, Ctenocephalides felis
tccatcataaaattggtcgatgaaggagtagatcttaaacctggtaccttgttaactgttactggatggggatcaactagaaatggaccttcaaccaatgttttgcaagaagttcaagtaccacatgtcgaccaaaccacttgctccaaatcttacccaggaagtttgactgatcgtatgttctgcgctggatatttgggacaaggaggcaaggactcttgtcaaggtgactctggtggcccagtagtcgtcaatggagttcaacacggaattgtatcctggggtcgtggttgtgcacttcctgattatcccggagtttactctaaaatctctaccgctcgcagctggatcaaggaagtgtctggtgtttaatttattcttgaaatctctattttgtattatttatgtatatagtaagagttttaaatataaatagtaacatttaaaaaaaaaaaaaaaaa

SEQ ID NO: 2307 - DNA, 501 bp, Ctenocephalides felis
  misc_feature (423)..(423): n = unknown
  misc_feature (468)..(468): n = unknown
gtctttataaaattgttatagaatttaatttttatgttaaaaagcgtaaatattattaaaggacgagaagaccctttaaagttttatatataaatatagattaattttaagaatattattaaatttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccaataattcttacatgatctgagttcaaaccggtttaagccaggttggtttctatccttaattntttaaaattaattagtcgaaaggccattaatttataataattatntaatttgaataaataaaaaaaaaaaaaaaaaaa

SEQ ID NO: 2308 - DNA, 307 bp, Ctenocephalides felis
tttaaaataacaaaatgaaaggaacattattaatattatcatgtcttgtgatcatgataagtgccgaatatgctgacgtagatgtgtgccaagatttggacgatggaacttttcttgctgattcaaacaattgccaaaatttcttcatttgtgatggaggccgagcttggaaaatgtattgtccaggatcacttttatggaatgatcacgaaggaacatgtgattacgcacaaaatgtagaatgttaccaaccagaataaaacattttaatatctgaaaaaaaaaaaaaaaaaaaaaaaaaaaaaaa

SEQ ID NO: 2309 - DNA, 545 bp, Ctenocephalides felis
tatttactaaatattgtgaaataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacgccgaagccctcagagcacaagccaaggatgcgttgtgaccgcagccgtgtcgatgaaccagagtttgctggaaggggttctccagctg

SEQ ID NO: 2310 - DNA, 521 bp, Ctenocephalides felis
  misc_feature (442)..(442): n = unknown
ccattccctgctatatcgggtcgagtttgcaaaagagttttatttaatttattgttgccgcccgtgttaaattaagtaaactttttcaagatgatgcccgcacttgcagacccagtggctttcgccaaggatttcgccgcaggtggtatttctgccgcagtctctaagactgtggtagcacccatcgaacgtgtcaaattgctcctgcaagtacaacacatttccaaacaaattgctgaggataaacgttacaaaggtatcatcgattgctttgtacgtatccctaaggagcagggcgtactttccttctggcgtggtaacttggccaatgtcattcgttatttcccaactcaggctttgaacttcgcattcaaagacaagtacaagcaagttttcttgggtggagttgacaagaagacccaattctggcgttacttcgcangaaacttggcatctggtggtgtgtggaccacatcattgtgcttcgctacccattgattcgccgaccagattgccgtgtg

SEQ ID NO: 2311 - DNA, 549 bp, Ctenocephalides felis
  misc_feature (356)..(356): n = unknown
  misc_feature (526)..(526): n = unknown
gttttcaagaataaattacaaataaatactgaattatactaaaaaaccatgtcggcaagcttggctgctaggagatcattgggtactttatggaggcaaggatggaatgaaattcctgaagtaatgcttagtactgccatgggaatggcaggaattggcatcagctgttatgccatttatagaacctatgtacttgaaggtggagactacagaaaatatcgaatgggatatgttgtatatcgccctgatgaccccagagtagcaaaaattcgtccagaagatcgataaattatgaatgatagtatattattttaaaattaacaagtatagttaatgtaaatatcttatatttttgngattttatttgtttgctctaaaggtgttctgttttgcctaagctcttattctggttctaattactatcagcttattgtgatcacaataaatcaggcatattcatgtaaattgtgcacattgatgttgtagtctatactatatgaaaagcacccattgctatcaaataaantaataaatccaaaaaaaaaaaaa

SEQ ID NO: 2312 - DNA, 204 bp, Ctenocephalides felis
gacttatactatgtttatggttccaatagtgccaaactttcagttgtcggtgatgttgttggacccatttttccaaccatgcctgttaatgctacatctttattagatcttccaatggactctgctgaacaaaatatgtttagttttgctgcaaacttatatactacaatgtatatgagattaataagtcaaagaaatcgaacg

SEQ ID NO: 2313 - DNA, 545 bp, Ctenocephalides felis
tgaattcattaagtaaaaacagtaagtttatagttagtagtaagcgtaacgccgtcagcagcacccaggccgaatctttctgtatctctctgggtgtcgggcctctgtggtggtcctgatgacttccaccacgagataggacatagcccaccaccttaccatgaagacgacgaccagctgcggcacacccgcaaaagcagcataagtgatagcgattcagaagacgattctattgatacttcgccggattattcccagaacgcggatgtcgatgagttacttcaccttggcaaaccagtacgcattacattcgaactacggctcacgaagcgcaacagcaccctatgggagacagttttgaaggagaacgtgctctatgtaaatattcctaatgtattgcttctgaggggtctcgtgaaagtttcacggcgctcctggaactgaccgaggagaagctgggatgccattcgatggtgtgtgcatgcacgcgatcgtcagacagacagcagctcatgcggcattatgttcctcggtccactgtgccc

What is claimed is:

1. An isolated nucleic acid molecule comprising a nucleic acid sequence selected from the group consisting of:
   a. a nucleic acid sequence selected from the group consisting of SEQ ID NO:23, SEQ ID NO:26, SEQ ID NO:230 and SEQ ID NO:2107, and;
   b. a nucleic acid sequence fully complementary to the nucleic acid sequence of (a).

2. An isolated nucleic acid molecule selected from the group consisting of:
   a. a nucleic acid molecule consisting of at least 200 contiguous nucleotides from SEQ ID NO: 23, SEQ ID NO:26, or SEQ ID NO:230;
   b. a nucleic acid molecule consisting of at least 375 contiguous nucleotides from SEQ ID NO:2107; and
   c. a nucleic acid sequence fully complementary to the nucleic acid sequence of (a) or (b).

3. The isolated nucleic acid molecule of claim 2, wherein said nucleic acid molecule consists of a nucleic acid sequence selected from the group consisting of:
   a. a nucleic acid sequence selected from the group consisting of SEQ ID NO:23, SEQ ID NO:26, SEQ ID NO:230 and SEQ ID NO:2107, and;
   b. a nucleic acid sequence fully complementary to the nucleic acid sequence of (a).

* * * * *